(12) United States Patent
Checa Rojas et al.

(10) Patent No.: US 11,160,844 B2
(45) Date of Patent: *Nov. 2, 2021

(54) METHODS OF DIAGNOSING AND TREATING CERVICAL CANCER BASED ON EXPRESSION OF FARNESYL PYROPHOSPHATE SYNTHASE

(71) Applicant: TIMSER, S.A.P.I. DE C.V., Mexico City (MX)

(72) Inventors: Alberto Checa Rojas, Morelos (MX); Orlando Santillan Godinez, Morelos (MX); Raul Dominguez Palestino, Mexico City (MX)

(73) Assignee: Timser, S.A.P.I. de C.V., Mexico City (MX)

( * ) Notice: Subject to any disclaimer, the term of this patent is extended or adjusted under 35 U.S.C. 154(b) by 0 days.

This patent is subject to a terminal disclaimer.

(21) Appl. No.: 17/069,744

(22) Filed: Oct. 13, 2020

(65) Prior Publication Data
US 2021/0093692 A1 Apr. 1, 2021

Related U.S. Application Data

(63) Continuation of application No. 16/879,748, filed on May 20, 2020.

(51) Int. Cl.
*A61K 38/16* (2006.01)
*G01N 33/52* (2006.01)
*G01N 33/53* (2006.01)
*A61K 51/08* (2006.01)

(52) U.S. Cl.
CPC .............. *A61K 38/16* (2013.01); *A61K 51/08* (2013.01); *G01N 33/52* (2013.01); *G01N 33/53* (2013.01)

(58) Field of Classification Search
CPC ........ A61K 38/16; A61K 51/08; G01N 33/52; G01N 33/53
See application file for complete search history.

(56) References Cited

U.S. PATENT DOCUMENTS

| | | |
|---|---|---|
| 2007/0224201 A1 | 9/2007 | Wu et al. |
| 2009/0269731 A1 | 10/2009 | Reed |
| 2014/0343860 A1 | 11/2014 | Egan et al. |
| 2017/0182186 A1 | 6/2017 | Markovic et al. |

FOREIGN PATENT DOCUMENTS

| | | |
|---|---|---|
| WO | WO 2007/007205 | 1/2007 |
| WO | WO 2019/033866 | 2/2019 |

OTHER PUBLICATIONS

Notarnicola M, et al. (2004) Oncology. 67:351-358. (DOI: 10.1159/000082918).*
Abate M, et al. (Oct. 26, 2017) Scientific Reports. 7: 14123 (10 pages). (DOI:10.1038/s41598-017-14495-6).*
Todenhofer T, et al. (2013) World J Urol. 31:345-350. (DOI 10.1007/s00345-012-0844-y).*
Checa-Rojas et al., "GSTM3 and GSTP1: novel players driving tumor progression in cervical cancer", Oncotarget, 2018, 9(31):21696-21714.
Kontostathi et al., "Cervical Cancer Cell Line Secretome Highlights the Roles of Transforming Growth Factor-Beta-Induced Protein ig-h3, Peroxiredoxin-2, and NRF2 on Cervical Carcinogenesis", BioMed Research International,2017, 16 pages.
MX Office Action in Mexican Application No. Mx/a/2019/005940, dated Feb. 6, 2020, 6 pages.
Garbett et al., "Detection of Cervical Cancer Biomarker Patterns in Blood Plasma and Urine by Differential Scanning Calorimetry and Mass Spectrometry", PLoS One, 9(1):1-12, Jan. 8, 2014.
PCT International Search Report and Written Opinion in International Application No. PCT/162020/000395, dated Jan. 28, 2021, 16 pages.

* cited by examiner

*Primary Examiner* — Robert S Landsman
(74) *Attorney, Agent, or Firm* — DLA Piper LLP (US)

(57) ABSTRACT

The present invention is related to diagnostic tests or rapid detections of different types of cancer, especially cervical cancer and precancerous lesions. Especially, the invention relates to specific and useful protein biomarkers for the detection of said diseases, and to the methods for determination and detection of said biomarkers.

7 Claims, 17 Drawing Sheets
Specification includes a Sequence Listing.

TOTAL PROTEIN PER CELL LINE:
- HELA: 432
- SIHA: 447
- C-33A: 343
- HACAT: 440

UNIQUE PROTEINS:
- HELA: 115
- SIHA: 100
- C-33A: 67
- HACAT: 107

PROTEINS SHARED BETWEEN CELL LINES:
- C-33 VS HELA VS SIHA:
- SIHA VS C-33: 13
- HELA VS C-33: 11
- SIHA VS HELA: 45

PRE-CANCEROUS LESIONS L1

PRE-CANCEROUS LESIONS L2

CONTROLS

PRE-CANCEROUS LESIONS L1

PRE-CANCEROUS LESIONS L2

CONTROLS

METHODS OF DIAGNOSING AND TREATING CERVICAL CANCER BASED ON EXPRESSION OF FARNESYL PYROPHOSPHATE SYNTHASE

CROSS-REFERENCE TO RELATED APPLICATIONS

This application is a Continuation of U.S. patent application Ser. No. 16/879,748 filed May 20, 2020, which claims priority and the benefit under 35 USC § 119(a) of International Application, Mexican Patent Application No. MX/a/2019/005940 filed May 21, 2019, the entire contents of which is incorporated herein by reference in its entirety.

INCORPORATION OF SEQUENCE LISTING

The material in the accompanying sequence listing is hereby incorporated by reference into this application. The accompanying sequence listing text file, name ATSO1100_2_Sequence_Listing.txt, was created on Oct. 13, 2020, and is 748 kb. The file can be accessed using Microsoft Word on a computer that uses Windows OS.

BACKGROUND OF THE INVENTION

Field of the Invention

The present invention relates generally to methods of diagnosing and treating cervical cancer in a subject and more specifically to biomarkers used to diagnose cervical cancer.

Background Information

Cervical cancer (CC) is one of the most common cancers among women worldwide. Among the risk factors related to this disease are infection with the human papilloma virus (HPV), the microbiome, risky sexual behavior, multiparity, smoking, prolonged use of hormonal contraceptives and environmental factors. Cervical cancer is a disease of slow and progressive evolution. It is preceded by cervical intraepithelial neoplasms, which are the lesions considered to be the prelude to this condition. These malignancies or injuries can occur even 10 years before cervical cancer develops.

Human papillomavirus infection (HPV) causes more than 90% of cases. Other risk factors include smoking, a weak immune system, birth control pills, starting sex at a young age, and having many sexual partners, but these are less important. Cervical cancer typically develops from precancerous changes over 10 to 20 years. About 90% of cervical cancer cases are squamous cell carcinomas, 10% are adenocarcinoma, and a small number are other types. Diagnosis is typically by cervical screening followed by a biopsy. Medical imaging is then done to determine whether or not the cancer has spread.

Current methods of diagnosing cervical cancer are invasive. The most common method of diagnosing cervical cancer is by a smear screening with Papanicolaou staining, i.e. Pap smear. There is a need for non-invasive methods of detecting cervical cancer.

SUMMARY OF THE INVENTION

The present invention is based on the seminal discovery that a collection of biomarkers can be used for the diagnosis of cervical cancer.

In one embodiment, the present invention is directed to methods of detecting at least one polypeptide in a sample from a subject; wherein the at least one polypeptide is selected from Farnesyl pyrophosphate synthase, neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, Heat Shock Protein Cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof; or a polypeptide with at least about 70% sequence identity to a polypeptide having the amino acid sequence selected from SEQ ID NOs: 1-20 or a fragment thereof; and diagnosing cervical cancer based on the detection of the at least one polypeptide.

In one aspect, the sample is selected from the group consisting of blood, plasma, urine, saliva, sweat, organ biopsy, cerebrospinal fluid (CSF), tear, vaginal fluid, feces, skin, and hair. In certain aspects the sample is a blood sample and the subject is human.

In another aspect, the at least one polypeptide is Farnesyl pyrophosphate synthase or a fragment thereof and at least one polypeptide selected from neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, Heat shock protein cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof. In an additional aspect, the at least one polypeptide is a polypeptide having at least about 70% sequence identity to a polypeptide having the amino acid sequence of SEQ ID NO:1 or a fragment thereof and at least one polypeptide with at least about 70% sequence identity to a polypeptide having the amino acid sequence selected from SEQ ID NOs:2-20 and a fragment thereof.

In a further aspect, the detecting is by protein microarray, fluorescence detection, flow cytometry, microfluidic device, lateral flow assay, vertical flow assay or immunoassay. In a specific aspect, the detecting is by lateral flow assay. In one aspect, the method also includes administering a treatment to the subject. In an additional aspect, the treatment is surgery, radiation, chemotherapy, targeted therapy and/or immunotherapy.

In another embodiment, the present invention provides a method of diagnosing cervical cancer in a subject by detecting at least one polypeptide in a sample from a subject; wherein the at least one polypeptide is selected from Farnesyl pyrophosphate synthase, neurofibromin 1, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, Heat shock protein cognate protein 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof; or a polypeptide with at least about 70% sequence identity to a polypeptide having the amino acid sequence selected from SEQ ID NOs: 1-20 or a fragment thereof, and diagnosing cervical cancer based on the detection of at least one polypeptide.

In one aspect, the sample is blood, plasma, urine, saliva, sweat, organ biopsy, cerebrospinal fluid (CSF), tear, vaginal fluid, feces, skin, and hair. In certain aspects, the sample is a blood sample and the subject is human.

In an additional aspect, the at least one polypeptide is Farnesyl pyrophosphate synthase or a fragment thereof and at least one polypeptide selected from neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, Cognate thermal shock protein 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof. In a further aspect, the at least one polypeptide is a polypeptide with at least about 70% sequence identity to a polypeptide having the amino acid sequence of SEQ ID NO:1 or a fragment thereof and at least one polypeptide with at least about 70% sequence identity to a polypeptide having an amino acid sequence selected from SEQ ID NOs:2-20 or a fragment thereof.

In another aspect, the detecting is by protein microarray, fluorescence detection, flow cytometry, microfluidic device, lateral flow assay, vertical flow assay or immunoassay. In a specific aspect, the detecting is by lateral flow assay. In one aspect, the method also includes administering a treatment to the subject. In certain aspects, the treatment is surgery, radiation, chemotherapy, targeted therapy and/or immunotherapy.

In an additional embodiment, the present invention provides a method of treating cervical cancer in a subject in need thereof, the method is detecting at least one polypeptide in a sample from a subject; wherein the at least one polypeptide is selected from Farnesyl pyrophosphate synthase, neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, Heat shock protein cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof; or a polypeptide with at least about 70% sequence identity to a polypeptide having the amino acid sequence selected from SEQ ID NOs: 1-20 or a fragment thereof, diagnosing cervical cancer based on the detection of the at least one polypeptide; and administering a treatment to the subject. In one aspect, the sample is a blood sample.

In an additional aspect, the at least one polypeptide is Farnesyl pyrophosphate synthase or a fragment thereof and at least one polypeptide selected from neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, Heat shock protein cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof. In a further embodiment, the at least one polypeptides is a polypeptide with at least about 70% sequence identity to a polypeptide having the amino acid sequence of SEQ ID NO:1 or a fragment thereof and at least one polypeptide with at least about 70% sequence identity to a polypeptide with an amino acid sequence selected from SEQ ID NOs:2-20 or a fragment thereof.

In another aspect, the detecting is by protein microarray, fluorescence detection, flow cytometry, microfluidic device, lateral flow assay, vertical flow or immunoassay. In a specific aspect, the detecting is by lateral flow assay. In an additional aspect, the treatment is selected from the group consisting of surgery, radiation, chemotherapy, targeted therapy and immunotherapy.

In a further aspect, the chemotherapy is Cisplatin, Carboplatin, Paclitaxel, Topotecan, docetaxel, ifosfamide, 5-fluorouracil, irinotecan, gemcitabine or mitomycin. In certain aspects, the targeted therapy is bevacizumab and the immunotherapy is pembrolizumab.

In a further embodiment, the present invention provides methods of predicting a response to treatment for a subject having cervical cancer by detecting at least one polypeptide in a sample from a subject; wherein the at least one polypeptide is selected from Farnesyl pyrophosphate synthase, neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, heat shock protein cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof, or a polypeptide with at least about 70% sequence identity to a polypeptide having amino acid sequence selected from SEQ ID NOs: 1-20 or a fragment thereof; and predicting a response to treatment based on the detection of the at least one polypeptide.

In one aspect, the at least one polypeptide is Farnesyl pyrophosphate synthase or a fragment thereof and at least one polypeptide selected from neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, Heat shock protein cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof. In another aspect, the at least one polypeptide is a polypeptide with at least about 70% sequence identity to a polypeptide having the amino acid sequence of SEQ ID NO:1 or a fragment thereof and at least one polypeptide with at least about 70% sequence identity to a polypeptide having the amino acid sequence selected from SEQ ID NOs:2-20 or a fragment thereof.

In an additional aspect, the detecting is by protein microarray, fluorescence detection, flow cytometry, microfluidic device, lateral flow assay, vertical flow or immunoassay. In a further aspect, the detecting is by lateral flow assay. In certain aspects, the treatment is surgery, radiation, chemotherapy, targeted therapy and immunotherapy.

In another embodiment, the present invention provides methods for determining the stage of cervical cancer in a subject in need thereof by detecting at least one polypeptide in a sample from the subject; wherein the at least one polypeptide is selected from Farnesyl pyrophosphate synthase, neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, heat shock protein cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof; or a polypeptide with at least about 70% sequence identity to a polypeptide having the amino acid sequence selected from SEQ ID NOs: 1-20 or a fragment thereof; and determining the stage of cervical cancer in the subject based on the detection of the at least one polypeptide.

In one aspect, the at least one polypeptide is Farnesyl pyrophosphate synthase or a fragment thereof and at least one polypeptide selected from neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, Heat shock protein cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof. In another aspect, the at least one polypeptide is a polypeptide with at least about 70% sequence identity to a polypeptide having the amino acid sequence of SEQ ID NO:1 or a fragment thereof and at least one polypeptide with at least about 70% sequence identity to a polypeptide having the amino acid sequence selected from SEQ ID NOs:2-20 or a fragment thereof.

In an additional aspect, the detecting is by protein microarray, fluorescence detection, flow cytometry, microfluidic device, lateral flow assay, vertical assay or immunoassay. In a specific aspect, the detecting is by lateral flow assay. In a further aspect, the method also includes administering a treatment to the subject. In certain aspects, the treatment is surgery, radiation, chemotherapy, targeted therapy or immunotherapy. In one aspect, the cervical cancer is stage I, stage II, stage III or stage IV.

In one embodiment, the present invention provides a kit with a sample collection unit; a lateral flow device; and instructions for using the lateral flow device.

In one aspect, the lateral flow device detects at least one polypeptide selected from Farnesyl pyrophosphate synthase, neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, heat shock protein cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof; or a polypeptide with at least about 70% sequence identity to a polypeptide having the amino acid sequence selected from SEQ ID NOs: 1-20 or a fragment thereof.

In an additional aspect, the at least one polypeptide is Farnesyl pyrophosphate synthase or a fragment thereof and at least one polypeptide selected from neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, heat shock protein cognate 71 kDa, Ankyrin-3, Rho 23 GTPase-activating protein, Cytoskeletal Keratin 78 type II, Alph-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof. In a further aspect, the at least one polypeptide is a polypeptide with at least about 70% sequence identity to a polypeptide having the amino acid sequence of SEQ ID NO:1 or a fragment thereof and at least one polypeptide with at least about 70% sequence identity to a polypeptide having the amino acid sequence selected from SEQ ID NOs:2-20 or a fragment thereof.

In another aspect, the lateral flow device detects the at least one polypeptide by an immunoassay. In one aspect, the sample collection unit collects a blood sample.

In an additional aspect, the present invention provides a use of the detection of at least one polypeptide for the diagnosis of cervical cancer in a subject in need thereof, wherein the at least one polypeptide is selected from Farnesyl pyrophosphate synthase, neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, heat shock protein cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof, or a polypeptide with at least about 70% sequence identity to a polypeptide having the amino acid sequence selected from SEQ ID NOs: 1-20 or a fragment thereof.

In a further aspect, the at least one polypeptide is detected in a sample from the subject and the sample is a blood sample. In another aspect, the at least one polypeptide is Farnesyl pyrophosphate synthase or a fragment thereof and at least one polypeptide selected from neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, heat shock protein cognate 71 kDa, Ankyrin-3, Rho 23 GTPase-activating protein, Cytoskeletal Keratin 78 type II, Alph-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof. In one aspect, the at least one polypeptide is a polypeptide with at least about 70% sequence identity to a polypeptide having the amino acid sequence of SEQ ID NO:1 or a fragment thereof and at least one polypeptide with at least about 70% sequence identity to a polypeptide having the amino acid sequence selected from SEQ ID NOs:2-20 or a fragment thereof.

In another aspect, the detecting is by protein microarray, fluorescence detection, flow cytometry, microfluidic device, lateral flow assay, vertical flow or immunoassay. In certain aspects, the detecting is by lateral flow assay.

DETAILED DESCRIPTION OF THE INVENTION

Figure 1:
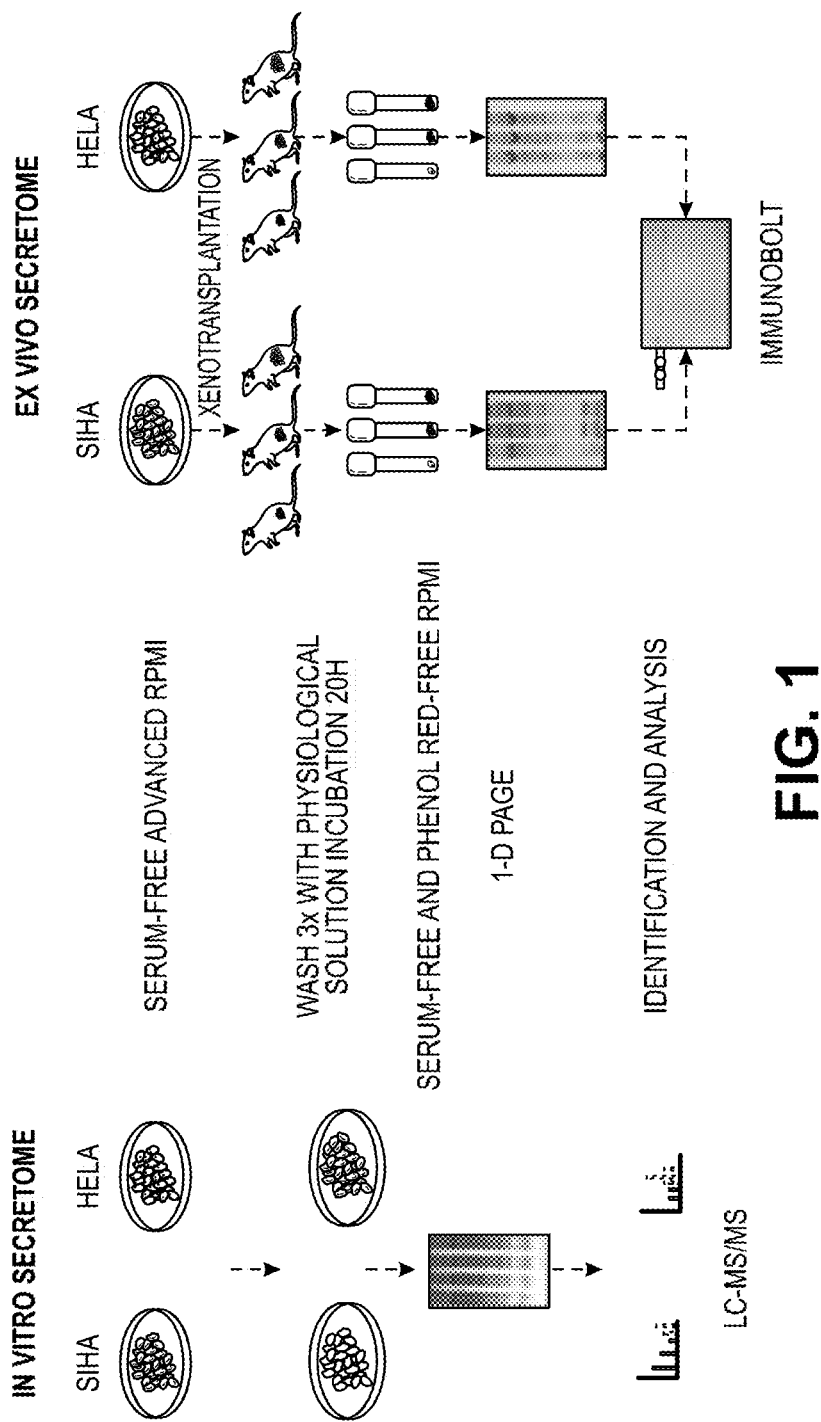
FIG. 1 shows the workflows to obtain secreted proteins in vivo or ex vivo.

The present invention is based on the seminal discovery that a collection of biomarkers can be used for the diagnosis of cervical cancer.

Before the present compositions and methods are described, it is to be understood that this invention is not limited to particular compositions, methods, and experimental conditions described, as such compositions, methods, and conditions may vary. It is also to be understood that the terminology used herein is for purposes of describing particular embodiments only, and is not intended to be limiting, since the scope of the present invention will be limited only in the appended claims.

As used in this specification and the appended claims, the singular forms "a", "an", and "the" include plural references unless the context clearly dictates otherwise. Thus, for example, references to "the method" includes one or more methods, and/or steps of the type described herein which will become apparent to those persons skilled in the art upon reading this disclosure and so forth.

All publications, patents, and patent applications mentioned in this specification are herein incorporated by reference to the same extent as if each individual publication, patent, or patent application was specifically and individually indicated to be incorporated by reference.

Unless defined otherwise, all technical and scientific terms used herein have the same meaning as commonly understood by one of ordinary skill in the art to which this invention belongs. Although any methods and materials similar or equivalent to those described herein can be used in the practice or testing of the invention, it will be understood that modifications and variations are encompassed within the spirit and scope of the instant disclosure. The preferred methods and materials are now described.

Cervical cancer (CC) is one of the most common cancers among women worldwide. Among the risk factors related to this disease are infection with the human papilloma virus (HPV), the microbiome, risky sexual behavior, multiparity, smoking, prolonged use of hormonal contraceptives and environmental factors. Cervical cancer is a disease of slow and progressive evolution. It is preceded by cervical intra-epithelial neoplasms, which are the lesions considered to be the prelude to this condition.

These lesions are generally asymptomatic, making it difficult to detect the disease in a timely manner, so if they are not detected by any of the conventional methods, there is a risk that they will develop to the state of CC. Due to this, the diagnosis of neoplastic lesions or cancer in early stages, from HPV infection, is extremely important to be able to channel and treat these cases in a timely and adequate manner.

Currently the gold standard for the diagnosis of CC is the Pap test, while for the detection of HPV the most widely used method is detection by PCR and sequencing of the viral genome. Although both methods are an international benchmark, these tests have technical limitations, since highly trained personnel, facilities and specialized equipment are required; Furthermore, it is not easily accessible to the entire female population and the existence of socio-cultural beliefs prevent women from making diagnoses.

Molecular biomarkers would help in the detection of cervical cancer using non-invasive methods. These biomarkers will serve as detection, prognosis, or follow-up of treatment of preneoplastic lesions and cancers in early stages based on patient serum samples. Thus being able to decrease the incidence of the disease that continues to be a public health problem in many low and high income countries.

Due to all of the above, there is an urgent need to develop new and simpler disease detection methods that are applicable in early detection, specific, highly sensitive, inexpensive, and easily accessible to the population.

The methods, compositions, and kits disclosed herein may be used for the diagnosis, prognosis, and/or monitoring the status or outcome of a cancer in a subject. In some embodiments, the diagnosing, predicting, and/or monitoring the status or outcome of a cancer comprises determining the malignancy or malignant potential of the cancer or tumor. Alternatively, the diagnosing, predicting, and/or monitoring the status or outcome of a cancer comprises determining the stage of the cancer. The diagnosing, predicting, and/or monitoring the status or outcome of a cancer can comprise determining the tumor grade. Alternatively, the diagnosing, predicting, and/or monitoring the status or outcome of a cancer comprises assessing the risk of developing a cancer. In some embodiments, the diagnosing, predicting, and/or monitoring the status or outcome of a cancer includes assessing the risk of cancer recurrence. In some embodiments, diagnosing, predicting, and/or monitoring the status or outcome of a cancer may comprise determining the efficacy of treatment.

In one embodiment, the present invention is directed to methods of detecting at least one polypeptide in a sample from a subject; wherein the at least one polypeptide is selected from Farnesyl pyrophosphate synthase, neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, Heat Shock Protein Cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof; or a polypeptide with at least about 70% sequence identity to a polypeptide having the amino acid sequence selected from SEQ ID NOs: 1-147 or a fragment thereof; and diagnosing cervical cancer based on the detection of the at least one polypeptide. In one aspect, the at least one polypeptide is a polypeptide with at least about 70% sequence identity to a polypeptide having the amino acid sequence selected from SEQ ID NOs:1-20 or a fragment thereof.

As used herein, the terms "detect", "detecting" or "detection" may describe either the general act of discovering or discerning or the specific observation of a polypeptide. Detecting may comprise determining the presence or absence of a polypeptide. Detecting may comprise quantifying a polypeptide. For example, detecting comprises determining the expression level of a polypeptide. For example, the polypeptide may comprise at least a portion of the polypeptides disclosed herein.

The polypeptides or biomarkers of the present invention can be detected by any method that can be used for the specific detection and/or identification of a protein, peptide, fragment thereof, variant thereof, or mutant thereof. Examples of method of detecting protein include, but are not limited to: spectrometry methods, such as high-performance liquid chromatography (HPLC), partition chromatography, normal-phase chromatography, displacement chromatography, reversed-phase chromatography (RPC), size-exclusion chromatography, ion-exchange chromatography, bioaffinity chromatography, aqueous normal-phase chromatography, liquid chromatography-mass spectrometry (LC/MS); and antibody dependent or immunoassay based methods, such as enzyme-linked immunosorbent assay (ELISA), direct ELISA, sandwich ELISA, competitive ELISA, reverse ELISA, protein immunoprecipitation (direct or indirect), individual protein immunoprecipitation (P), protein complex immunoprecipitation (Co-IP), chromatin immunoprecipitation (ChIP), RNP Immunoprecipitation (RIP), immunoelectrophoresis, western blot, and protein immunostaining. The polypeptides or biomarkers of the present invention can also be detected using protein microarrays, lateral flow assays or vertical flow assays. In certain aspects, the polypeptides or biomarkers are detected using a lateral flow assay. A lateral flow assay is typically an immunoassay either a sandwich assay or competitive assay. Typically these assays use a conjugated gold, carbon or colored latex nanoparticles. Multiplexed assays may also be performed using these methods.

As used herein, the term "subject" refers to any organisms that are screened using the diagnostic methods and treated using the treatment methods described herein. Such organisms preferably include, but are not limited to, mammals (e.g., murines, simians, equines, bovines, porcines, canines, felines, and the like), and most preferably includes humans.

The term "diagnosed," as used herein, refers to the recognition of a disease by its signs and symptoms, or genetic analysis, pathological analysis, histological analysis, and the like. Specifically, the term refers to the diagnosis or detection of cervical cancer.

The biomarkers of the present invention serve various functions within cells.

Farnesylpyrophosphate synthase (FPPS), also known as Dimethylallyltranstransferase (DMATT) or as farnesyl-diphosphate synthase (FDPS), is an enzyme that in humans is encoded by the FDPS gene and catalyzes the transformation of dimethylallylpyrophosphate (DMAPP) and isopentenyl pyrophosphate (IPP) into farnesylpyrophosphate (FPP).

Neurofibromin 1 (NF1) is a gene in humans that is located on chromosome 17. NF1 codes for neurofibromin, a GTPase-activating protein that negatively regulates RAS/MAPK pathway activity by accelerating the hydrolysis of Ras-bound GTP. NF1 has a high mutation rate and mutations in NF1 can alter cellular growth control, and neural development, resulting in neurofibromatosis type 1 (NF1, also known as von Recklinghausen syndrome).

Glyceraldehyde 3-phosphate dehydrogenase (abbreviated as GAPDH or less commonly as G3PDH) (EC 1.2.1.12) is an enzyme of ~37 kDa that catalyzes the sixth step of glycolysis and thus serves to break down glucose for energy and carbon molecules. In addition to this long established metabolic function, GAPDH has recently been implicated in several non-metabolic processes, including transcription activation, initiation of apoptosis, ER to Golgi vesicle shuttling, and fast axonal, or axoplasmic transport.

Protein 1 containing fibronectin domain type III also known as Fibronectin type III domain containing protein-1 may be an activator of G protein signaling. Protein 1 containing fibronectin domain type III is encoded by the FNDC1 gene.

Eukaryotic initiation factor 4A-I is an ATP-dependent RNA helicase which is a subunit of the eIF4F complex involved in cap recognition and is required for mRNA binding to ribosome. In the current model of translation initiation, eIF4A unwinds RNA secondary structures in the 5'-UTR of mRNAs which is necessary to allow efficient binding of the small ribosomal subunit, and subsequent scanning for the initiator codon. The protein is encoded by the EIF4A1 gene.

L-lactate dehydrogenase chain B is involved in step 1 of the subpathway that synthesizes (S)-lactate from pyruvate. The protein is encoded by the LDHB gene.

Nuclear heterogeneous Ribonucleoprotein A1, also known as heterogeneous nuclear ribonucleoprotein A1, is involved in the packaging of pre-mRNA into hnRNP particles, transport of poly(A) mRNA from the nucleus to the cytoplasm and may modulate splice site selection. May bind to specific miRNA hairpins. Binds to the IRES and thereby inhibits the translation of the apoptosis protease activating factor APAF1. Nuclear heterogeneous Ribonucleoprotein A1 is encoded by the HNRNPA1 gene.

1-like protein 1 polycystic kidney disease, also known as polycystic kidney disease protein 1-like 1, is a component of a ciliary calcium channel that controls calcium concentration within primary cilia without affecting cytoplasmic calcium concentration. Forms a heterodimer with PKD2L1 in primary cilia and forms a calcium-permeant ciliary channel that regulates sonic hedgehog/SHH signaling and GLI2 transcription. Does not constitute the pore-forming subunit. Also involved in left/right axis specification downstream of nodal flow: forms a complex with PKD2 in cilia to facilitate flow detection in left/right patterning. Encoded by the PKD1L1 gene.

Heat Shock Protein Cognate 71 kDa is a molecular chaperone implicated in a wide variety of cellular processes, including protection of the proteome from stress, folding and transport of newly synthesized polypeptides, activation of proteolysis of misfolded proteins and the formation and dissociation of protein complexes. Plays a pivotal role in the protein quality control system, ensuring the correct folding of proteins, the re-folding of misfolded proteins and controlling the targeting of proteins for subsequent degradation. This is achieved through cycles of ATP binding, ATP hydrolysis and ADP release, mediated by co-chaperones. The co-chaperones have been shown to not only regulate different steps of the ATPase cycle of HSP70, but they also have an individual specificity such that one co-chaperone may promote folding of a substrate while another may promote degradation. The affinity of HSP70 for polypeptides is regulated by its nucleotide bound state. In the ATP-bound form, it has a low affinity for substrate proteins. However, upon hydrolysis of the ATP to ADP, it undergoes a conformational change that increases its affinity for substrate proteins. HSP70 goes through repeated cycles of ATP hydrolysis and nucleotide exchange, which permits cycles of substrate binding and release. The HSP70-associated co-chaperones are of three types: J-domain co-chaperones HSP40s (stimulate ATPase hydrolysis by HSP70), the nucleotide exchange factors (NEF) such as BAG1/2/3 (facilitate conversion of HSP70 from the ADP-bound to the ATP-bound state thereby promoting substrate release), and the TPR domain chaperones such as HOPX and STUB1. Acts as a repressor of transcriptional activation. Inhibits the transcriptional coactivator activity of CITED1 on Smad-mediated transcription. Component of the PRP19-CDC5L complex that forms an integral part of the spliceosome and is required for activating pre-mRNA splicing. May have a scaffolding role in the spliceosome assembly as it contacts all other components of the core complex. Binds bacterial lipopolysaccharide (LPS) and mediates LPS-induced inflammatory response, including TNF secretion by monocytes. Participates in the ER-associated degradation (ERAD) quality control pathway in conjunction with J domain-containing co-chaperones and the E3 ligase STUB1. Interacts with VGF-derived peptide TLQP-21. This protein is encoded by the HSPA8 gene.

Ankyrin 3 is found in skeletal muscle and is required for costamere localization of DMD and betaDAG1 (By similarity). Membrane-cytoskeleton linker. The protein may participate in the maintenance/targeting of ion channels and cell adhesion molecules at the nodes of Ranvier and axonal initial segments. Regulates KCNA1 channel activity in function of dietary Mg levels, and thereby contributes to the regulation of renal Mg reabsorption. Ankyrin-3 is encoded by the ANK3 gene.

Rho 23 GTPase-activating protein, also known as Rho GTPase activating protein 23, is part of the RHO family of small GTPases which are involved in signal transduction through transmembrane receptors, and they are inactive in the GDP-bound form and active in the GTP-bound form. GTPase-activating proteins, such as ARHGAP23, inactivate RHO family proteins by stimulating their hydrolysis of GTP. Rho GTPase-activating protein 23 is encoded by the ARHGAP23 gene.

Keratins are the major structural proteins in epithelial cells, forming a cytoplasmic network of 10 to 12 nm wide intermediate filaments and creating a scaffold that gives cells the ability to withstand mechanical and non-mechanical stresses. There are two types of cytoskeletal and microfibrillar keratin, I (acidic) and II (neutral to basic), i.e. Cytoskeletal Keratin 78 type II, also known as keratin, type II cytoskeletal 78. Cytoskeletal keratin 78 type II is encoded by the KRT78 gene.

Alpha 3 collagen chain (VI), also known as collagen alpha-3 (VI) chain, acts as a cell-binding protein. Collagen alpha-3 (VI) chain is encoded by the COL6A3 gene.

Beta subunit of proteasome type-5, also known as Proteasome subunit beta type-5 and 20S proteasome subunit beta-5 is a protein that in humans is encoded by the PSMB5 gene. This protein is one of the 17 essential subunits (alpha subunits 1-7, constitutive beta subunits 1-7, and inducible subunits including beta1i, beta2i, beta5i) that contributes to the complete assembly of 20S proteasome complex. In particular, proteasome subunit beta type-5, along with other beta subunits, assemble into two heptameric rings and subsequently a proteolytic chamber for substrate degradation. This protein contains "chymotrypsin-like" activity and is capable of cleaving after large hydrophobic residues of peptide. The eukaryotic proteasome recognized degradable proteins, including damaged proteins for protein quality control purpose or key regulatory protein components for dynamic biological processes. An essential function of a modified proteasome, the immunoproteasome, is the processing of class I MHC peptides. Beta subunit of proteasome type-5 is encoded by the PSMB5 gene.

Heterogeneous nuclear ribonucleoprotein (hnRNP) that associates with nascent pre-mRNAs, packaging them into hnRNP particles. The hnRNP particle arrangement on nascent hnRNA is non-random and sequence-dependent and serves to condense and stabilize the transcripts and minimize tangling and knotting. Packaging plays a role in various processes such as transcription, pre-mRNA processing, RNA nuclear export, subcellular location, mRNA translation and stability of mature mRNAs. Forms hnRNP particles with at least 20 other different hnRNP and heterogeneous nuclear RNA in the nucleus. Involved in transport of specific mRNAs to the cytoplasm in oligodendrocytes and neurons: acts by specifically recognizing and binding the A2RE (21 nucleotide hnRNP A2 response element) or the A2RE11 (derivative 11 nucleotide oligonucleotide) sequence motifs present on some mRNAs, and promotes their transport to the cytoplasm. Specifically binds single-stranded telomeric DNA sequences, protecting telomeric DNA repeat against endonuclease digestion (By similarity). Also binds other RNA molecules, such as primary miRNA (pri-miRNAs): acts as a nuclear 'reader' of the N6-methyladenosine (m6A) mark by specifically recognizing and binding a subset of nuclear m6A-containing pri-miRNAs. Binding to m6A-containing pri-miRNAs promotes pri-miRNA processing by enhancing binding of DGCR8 to pri-miRNA transcripts. Involved in miRNA sorting into exosomes following sumoylation, possibly by binding (m6A)-containing pre-miRNAs. Acts as a regulator of efficiency of mRNA splicing, possibly by binding to m6A-containing pre-mRNAs. Plays also a role in the activation of the innate immune response. Mechanistically, senses the presence of viral DNA in the nucleus, homodimerizes and is demethylated by JMJD6. In turn, translocates to the cytoplasm where it activates the TBK1-IRF3 pathway, leading to interferon alpha/beta production. Heterogeneous nuclear ribonucleoproteins A2/B1 is a protein that in humans is encoded by the HNRNPA2B1 gene.

Histone H2B type 1-B is a core component of nucleosome. Nucleosomes wrap and compact DNA into chromatin, limiting DNA accessibility to the cellular machineries which require DNA as a template. Histones thereby play a central role in transcription regulation, DNA repair, DNA replication and chromosomal stability. DNA accessibility is regulated via a complex set of post-translational modifications of histones, also called histone code, and nucleosome remodeling. Histone H2B type 1-B is encoded by the H2BC3 gene.

Homolog of DnaJ subfamily C member 13, also known as DnaJ homolog subfamily C member 13, is involved in membrane trafficking through early endosomes, such as the early endosome to recycling endosome transport implicated in the recycling of transferrin and the early endosome to late endosome transport implicated in degradation of EGF and EGFR. Involved in the regulation of endosomal membrane tubulation and regulates the dynamics of SNX1 on the endosomal membrane; via association with WASHC2 may link the WASH complex to the retromer SNX-BAR subcomplex. DnaJ homolog subfamily member 13 is encoded by the DNAJC13 gene.

Enolase 3 (ENO3), more commonly known as beta-enolase (ENO-β), is an enzyme that in humans is encoded by the ENO3 gene. This gene encodes one of the three enolase isoenzymes found in mammals. This isoenzyme is found in skeletal muscle cells in the adult where it may play a role in muscle development and regeneration. A switch from alpha enolase to beta enolase occurs in muscle tissue during development in rodents. Mutations in this gene have been associated with glycogen storage disease. Alternatively spliced transcript variants encoding different isoforms have been described.

Glutathione S-transferases (GSTs) are a family of enzymes that play an important role in detoxification by catalyzing the conjugation of many hydrophobic and electrophilic compounds with reduced glutathione. Based on their biochemical, immunologic, and structural properties, the soluble GSTs are categorized into four main classes: alpha, mu, pi, and theta. The glutathione S-transferase pi gene (GSTP1) is a polymorphic gene encoding active, functionally different GSTP1 variant proteins that are thought to function in xenobiotic metabolism and play a role in susceptibility to cancer, and other diseases. Glutathione S-transferase P is an enzyme that in humans is encoded by the GSTP1 gene.

Glutathione S-transferase Mu 3 may govern uptake and detoxification of both endogenous compounds and xenobiotics at the testis and brain blood barriers. Glutathione S-transferase Mu 3 is encoded by the GSTM3 gene.

The amino acid sequences for the biomarkers of the present invention and variants thereof are shown in Table 1.

TABLE 1

| Protein name/SEQ ID NO. | Amino acid sequence |
| --- | --- |
| Farnesyl pyrophosphate synthase (FDPS) SEQ ID NO: 1 | MPLSRWLRSVGVFLLPAPYWAPRERWLGSLRRPSLVHGYPVLAW HSARCWCQAWTEEPRALCSSLRMNGDQNSDVYAQEKQDFVQHFS QIVRVLTEDEMGHPEIGDAIARLKEVLEYNAIGGKYNRGLTVVVA FRELVEPRKQDADSLQRAWTVGWCVELLQAFFLVADDIMDSSLTR RGQICWYQKPGVGLDAINDANLLEACIYRLLKLYCREQPYYLNLIE LFLQSSYQTEIGQTLDLLTAPQGNVDLVRFTEKRYKSIVKYKTAFY SFYLPIAAAMYMAGIDGEKEHANAKKILLEMGEFFQIQDDYLDLF GDPSVTGKIGTDIQDNKCSWLVVQCLQRATPEQYQILKENYGQKE AEKVARVKALYEELDLPAVFLQYEEDSYSHIMALIEQYAAPLPPAV FLGLARKIYKRRK |
| Neurofibromin 1 (NF1) SEQ ID NO: 2 | MAAHRPVEWVQAVVSRFDEQLPIKTGQQNTHTKVSTEHNKECLIN ISKYKFSLVISGLTTILKNVNNMRIFGEAAEKNLYLSQLIILDTLEKC LAGQPKDTMRLDETMLVKQLLPEICHFLHTCREGNQHAAELRNSA SGVLFSLSCNNFNAVFSRISTRLQELTVCSEDNVDVHDIELLQYINV DCAKLKRLLKETAFKFKALKKVAQLAVINSLEKAFWNWVENYPD EFTKLYQIPQTDMAECAEKLFDLVDGFAESTKRKAAVWPLQIILLI LCPEIIQDISKDVVDENNMNKKLFLDSLRKALAGHGGSRQLTESAA IACVKLCKASTYINWEDNSVIFLLVQSMVVDLKNLLFNPSKPFSRG SQPADVDLMIDCLVSCFRISPHNNQHFKICLAQNSPSTFHYVLVNS LHRIITNSALDWWPKIDAVYCHSVELRNMFGETLHKAVQGCGAHP AIRMAPSLTFKEKVTSLKFKEKPTDLETRSYKYLLLSMVKLIHADP KLLLCNPRKQGPETQGSTAELITGLVQLVPQSHMPEIAQEAMEALL VLHQLDSIDLWNPDAPVETFWEISSQMLFYICKKLTSHQMLSSTEIL KWLREILICRNKFLLKNKQADRSSCHFLLFYGVGCDIPSSGNTSQM |

TABLE 1-continued

| Protein name/SEQ ID NO. | Amino acid sequence |
|---|---|
| | SMDHEELLRTPGASLRKGKGNSSMDSAAGCSGTPPICRQAQTKLE VALYMFLWNPDTEAVLVAMSCFRHLCEEADIRCGVDEVSVHNLL PNYNTFMEFASVSNMMSTGRAALQKRVMALLRRIEHPTAGNTEA WEDTHAKWEQATKLILNYPKAKMEDGQAAESLHKTIVKRRMSHV SGGGSIDLSDTDSLQEWINMTGFLCALGGVCLQQRSNSGLATYSPP MGPVSERKGSMISVMSSEGNADTPVSKFMDRLLSLMVCNHEKVG LQIRTNVKDLVGLELSPALYPMLFNKLKNTISKFFDSQGQVLLTDT NTQFVEQTIAIMKNLLDNHTEGSSEHLGQASIETMMLNLVRYVRV LGNMVHAIQIKTKLCQLVEVMMARRDDLSFCQEMKFRNKMVEYL TDWVMGTSNQAADDDVKCLTRDLDQASMEAVVSLLAGLPLQPEE GDGVELMEAKSQLFLKYFTLFMNLLNDCSEVEDESAQTGGRKRG MSRRLASLRHCTVLAMSNLLNANVDSGLMHSIGLGYHKDLQTRA TFMEVLTKILQQGTEFDTLAETVLADRFERLVELVTMMGDQGELPI AMALANVVPCSQWDELARVLVTLFDSRHLLYQLLWNMFSKEVEL ADSMQTLFRGNSLASKIMTFCFKVYGATYLQKLLDPLLRIVITSSD WQHVSFEVDPTRLEPSESLEENQRNLLQMTEKFFHAIISSSSEFPPQ LRSVCHCLYQATCHSLLNKATVKEKKENKKSVVSQRFPQNSIGAV GSAMFLRFINPAIVSPYEAGILDKKPPPRIERGLKLMSKILQSIANHV LFTKEEHMRPFNDFVKSNFDAARRFFLDIASDCPTSDAVNHSLSFIS DGNVLALHRLLWNNQEKIGQYLSSNRDHKAVGRRPFDKMATLLA YLGPPEHKPVADTHWSSLNLTSSKFEEFMTRHQVHEKEEFKALKT LSIFYQAGTSKAGNPIFYYVARRFKTGQINGDLLIYHVLLTLKPYY AKPYEIVVDLTHTGPSNRFKTDFLSKWFVVFPGFAYDNVSAVYIY NCNSWVREYTKYHERLLTGLKGSKRLVFIDCPGKLAEHIEHEQQK LPAATLALEEDLKVFHNALKLAHKDTKVSIKVGSTAVQVTSAERT KVLGQSVFLNDIYYASEIEEICLVDENQFTLTIANQGTPLTFMHQEC EAIVQSIIHIRTRWELSQPDSIPQHTKIRPKDVPGTLLNIALLNLGSSD PSLRSAAYNLLCALTCTFNLKIEGQLLETSGLCIPANNTLFIVSISKT LAANEPHLTLEFLEECISGFSKSSIELKHLCLEYMTPWLSNLVRFCK HNDDAKRQRVTAILDKLITMTINEKQMYPSIQAKIWGSLGQITDLL DVVLDSFIKTSATGGLGSIKAEVMADTAVALASGNVKLVSSKVIG RMCKIIDKTCLSPTPTLEQHLMWDDIAILARYMLMLSFNNSLDVA AHLPYLFHVVTFLVATGPLSLRASTHGLVINIIHSLCTCSQLHFSEET KQVLRLSLTEFSLPKFYLLFGISKVKSAAVIAFRSSYRDRSFSPGSYE RETFALTSLETVTEALLEIMEACMRDIPTCKWLDQWTELAQRFAF QYNPSLQPRALVVFGCISKRVSHGQIKQIIRILSKALESCLKGPDTY NSQVLIEATVIALTKLQPLLNKDSPLHKALFWVAVAVLQLDEVNL YSAGTALLEQNLHTLDSLRIFNDKSPEEVFMAIRNPLEWHCKQMD HFVGLNFNSNFNFALVGHLLKGYRHPSPAIVARTVRILHTLLTLVN KHRNCDKFEVNTQSVAYLAALLTVSEEVRSRCSLKHRKSLLLTDIS MENVPMDTYPIHHGDPSYRTLKETQPWSSPKGSEGYLAATYPTVG QTSPRARKSMSLDMGQPSQANTKKLLGTRKSFDHLISDTKAPKRQ EMESGITTPPKMRRVAETDYEMETQRISSSQQHPHLRKVSVSESNV LLDEEVLTDPKIQALLLTVLATLVKYTTDEFDQRILYEYLAEASVV FPKVFPVVHNLLDSKINTLLSLCQDPNLLNPIHGIVQSVVYHEESPP QYQTSYLQSFGFNGLWRFAGPFSKQTQIPDYAELIVKFLDALIDTY LPGIDEETSEESLLTPTSPYPPALQSQLSITANLNLSNSMTSLATSQH SPGIDKENVELSPTTGHCNSGRTRHGSASQVQKQRSAGSFKRNSIK KIV |
| Glyceraldehyde-3 phosphate dehydrogenase (GAPDH) SEQ ID NO: 3 | MGKVKVGVNGFGRIGRLVTRAAFNSGKVDIVAINDPFIDLNYMVY MFQYDSTHGKFHGTVKAENGKLVINGNPITIFQERDPSKIKWGDA GAEYVVESTGVFTTMEKAGAHLQGGAKRVIISAPSADAPMFVMG VNHEKYDNSLKIISNASCTTNCLAPLAKVIHDNFGIVEGLMTTVHA ITATQKTVDGPSGKLWRDGRGALQNIIPASTGAAKAVGKVIPELNG KLTGMAFRVPTANVSVVDLTCRLEKPAKYDDIKKVVKQASEGPL KGILGYIEHQVVSSDFNSDTHSSTFDAGAGIALNDHFVKLISWYDN EFGYSNRVVDLMAHMASKE |
| Protein 1 containing fibronectin domain type III or Fibronectin Type III Domain Containing protein 1 (FNDC1) SEQ ID NO: 4 | MAPEAGATLRAPRRLSWAALLLLAALLPVASSAAASVDHPLKPRH VKLLSTKMGLKVTWDPPKDATSRPVEHYNIAYGKSLKSLKYIKVN AETYSFLIEDVEPGVVYFVLLTAENHSGVSRPVYRAESPPGGEWIEI DGFPIKGPGPFNETVTEKEVPNKPLRVRVRSSDDRLSVAWKAPRLS GAKSPRRSRGFLLGYGESGRKMNYVPLTRDERTHEIKKLASESVY VVSLQSMNSQGRSQPVYRAALTKRKISEEDELDVPDDISVRVMSS QSVLVSWVDPVLEKQKKVVASRQYTVRYREKGELARWDYKQIA NRRVLIENLIPDTVYEFAVRISQGERDGKWSTSVFQRTPESAPTTAP ENLNWPVNGKPTVVAASWDALPETEGKVKEYILSYAPALKPFG AKSLTYPGDTTSALVDGLQPGERYLFKIRATNRRGLGPHSKAFIVA MPTTSKADVEQNTEDNGKPEKPEPSSPSPRAPASSQHPSVPASPQG RNAKDLLLDLKNKILANGGAPRKPQLRAKKAEELDLQSTEITGEEE LGSREDSPMSPSDTQDQKRTLRPPSRHGHSVVAPGRTAVRARMPA LPRREGVDKPGFSLATQPRPGAPPSASASPAHHASTQGTSHRPSLP ASLNDNDLVDSDEDERAVGSLHPKGAFAQPRPALSPSRQSPSSVLR DRSSVHPGAKPASPARRTPHSGAAEEDSSASAPPSRLSPPHGGSSRL LPTQPHLSSPLSKGGKDGEDAPATNSNAPSRSTMSSSVSSHLSSRTQ VSEGAEASDGESHGDGDREDGGRQAEATAQTLRARPASGHFHLL RHKPFAANGRSPSRFSIGRGPRLQPSSSPQSTVPSRAHPRVPSHSDS |

TABLE 1-continued

| Protein name/SEQ ID NO. | Amino acid sequence |
|---|---|
| | HPKLSSGIHGDEEDEKPLPATVVNDHVPSSSRQPISRGWEDLRRSP<br>QRGASLHRKEPIPENPKSTGADTHPQGKYSSLASKAQDVQQSTDA<br>DIEGHSPKAQPGSTDRHASPARPPAARSQQHPSVPRRMTPGRAPQ<br>QQPPPPVATSQHHPGPQSRDAGRSPSQPRLSLTQAGRPRPTSQGRS<br>HSSSDPYTASSRGMLPTALQNQDEDAQGSYDDDSTEVEAQDVRAP<br>AHAARAKEAAASLPKHQQVESPTGAGAGGDHRSQRGHAASPARP<br>SRPGGPQSRARVPSRAAPGKSEPPSKRPLSSKSQQSVSAEDDEEED<br>AGFFKGGKEDLLSSSVPKWPSSSTPRGGKDADGSLAKEEREPAIAL<br>APRGGSLAPVKRPLPPPPGSSPRASHVPSRLPPRSAATVSPVAGTHP<br>WPQYTTRAPPGHFSTTPMLSLRQRMMHARFRNPLSRQPARPSYRQ<br>GYNGRPNVEGKVLPGSNGKPNGQRIINGPQGTKWVVDLDRGLVL<br>NAEGRYLQDSHGNPLRIKLGGDGRTIVDLEGTPVVSPDGLPLFGQG<br>RHGTPLANAQDKPILSLGGKPLVGLEVIKKTTHPPTTTMQPTTTTTP<br>LPTTTTTPRPTTATTRRTTTTRRTTTTRRPTTTVRTTTRTTTTTTPTTT<br>PIPTCPPGTLERHDDDGNLIMSSNGIPECYAEEDEFSGLETDTAVPT<br>EEAYVIYDEDYEFETSRPPTTTEPSTTATTPRVIPEEGAISSFPEEEFD<br>LAGRKRFVAPYVTYLNKDPSAPCSLTDALDHFQVDSLDEIIPNDLK<br>KSDLPPQHAPRNITVVAVEGCHSFVIVDWDKATPGDVVTGYLVYS<br>ASYEDFIRNKWSTQASSVTHLPIENLKPNTRYYFKVQAQNPHGYG<br>PISPSVSFVTESDNPLLVVRPPGGEPIWIPFAFKHDPSYTDCHGRQY<br>VKRTWYRKFVGVVLCNSLRYKIYLSDNLKDTFYSIGDSWGRGED<br>HCQFVDSHLDGRTGPQSYVEALPTIQGYYRQYRQEPVRFGNIGFGT<br>PYYYVGWYECGVSIPGKW |
| Eukaryotic initiation factor 4A-I<br>(EIF4A1)<br>SEQ ID NO: 5 | MSASQDSRSRDNGPDGMEPEGVIESNWNEIVDSFDDMNLSESLLR<br>GIYAYGFEKPSAIQQRAILPCIKGYDVIAQAQSGTGKTATFAISILQQ<br>IELDLKATQALVLAPTRELAQQIQKVVMALGDYMGASCHACIGGT<br>NVRAEVQKLQMEAPHIIVGTPGRVFDMLNRRYLSPKYIKMFVLDE<br>ADEMLSRGFKDQIYDIFQKLNSNTQVVLLSATMPSDVLEVTKKFM<br>RDPIRILVKKEELTLEGIRQFYINVEREEWKLDTLCDLYETLTITQA<br>VIFINTRRKVDWLTEKMHARDFTVSAMHGDMDQKERDVIMREFR<br>SGSSRVLITTDLLARGIDVQQVSLVINYDLPTNRENYIHRIGRGGRF<br>GRKGVAINMVTEEDKRTLRDIETFYNTSIEEMPLNVADLI |
| L-lactate dehydrogenase chain B<br>(LDHB)<br>SEQ ID NO: 6 | MATLKEKLIAPVAEEEATVPNNKITVVGVGQVGMACAISILGKSLA<br>DELALVDVLEDKLKGEMMDLQHGSLFLQTPKIVADKDYSVTANS<br>KIVVVTAGVRQQEGESRLNLVQRNVNVFKFIIPQIVKYSPDCIIIVVS<br>NPVDILTYVTWKLSGLPKHRVIGSGCNLDSARFRYLMAEKLGIHPS<br>SCHGWILGEHGDSSVAVWSGVNVAGVSLQELNPEMGTDNDSEN<br>WKEVHKMVVESAYEVIKLKGYTNWAIGLSVADLIESMLKNLSRIH<br>PVSTMVKGMYGIENEVFLSLPCILNARGLTSVINQKLKDDEVAQLK<br>KSADTLWDIQKDLKDL |
| Nuclear heterogeneous<br>Ribonucleoprotein A1<br>(HNRNPA1)<br>SEQ ID NO: 7 | MSKSESPKEPEQLRKLFIGGLSFETTDESLRSHFEQWGTLTDCVVM<br>RDPNTKRSRGFGFVTYATVEEVDAAMNARPHKVDGRVVEPKRAV<br>SREDSQRPGAHLTVKKIFVGGIKEDTEEHHLRDYFEQYGKIEVIEIM<br>TDRGSGKKRGFAFVTFDDHDSVDKIVIQKYHTVNGHNCEVRKALS<br>KQEMASASSSQRGRSGSGNFGGGRGGGFGGNDNFGRGGNFSGRG<br>GFGGSRGGGGYGGSGDGYNGFGNDGGYGGGGPGYSGGSRGYGS<br>GGQGYGNQSGYGGSGSYDSYNNGGGGGFGGGSGSNFGGGGSY<br>NDFGNYNNQSSNFGPMKGGNFGGRSSGPYGGGGQYFAKPRNQGG<br>YGGSSSSSSYGSGRRF |
| Polycystic kidney disease protein<br>1-like 1<br>(PKD1L1)<br>SEQ ID NO: 8 | MAEEAAQNISDDQERCLQAACCLSFGGELSVSTDKSWGLHLCSCS<br>PPGGGLWVEVYANHVLLMSDGKCGCPWCALNGKAEDRESQSPSS<br>SASRQKNIWKTTSEAALSVVNEKTQAVVNEKTQAPLDCDNSADRI<br>PHKPFIIIARAWSSGGPRFHHRRLCATGTADSTFSALLQLQGTTSAA<br>APCSLKMEASCCVLRLLCCAEDVATGLLPGTVTMETPTKVARPTQ<br>TSSQRVPLWPISHFPTSPRSSHGLPPGIPRTPSFTASQSGSEILYPPTQ<br>HPPVAILARNSDNFMNPVLNCSLEVEARAPPNLGFRVHMASGEAL<br>CLMMDFGDSSGVEMRLHNMSEAMAVTAYHQYSKGIFFHLLHFQL<br>DMSTYKEAETQNTTLNVYLCQSENSCLEDSDPSNLGYELISAFVTK<br>GVYMLKAVIYNEFHGIEVELGPYYVEIGHEAVSAFMNSSSVHEDE<br>VLVFADSQVNQKSTVVIHHFPSIPSYNVSFISQTQVGDSQAWHSMT<br>VWYKMQSVSVYTNGTVFATDTDITFTAVTKETIPLEFEWYFGEDP<br>PVRTTSRSIKKRLSIPQWYRVMVKASNRMSSVVSEPHVIRVQKKIV<br>ANRLTSPSSALVNASVAFECWINFGTDVAYLWDFGDGTVSLGSSS<br>SSHVYSREGEFTVEVLAFNNVSASTLRQQLFIVCEPCQPPLVKNMG<br>PGKVQIWRSQPVRLGVTFEAAVFCDISQGLSYTWNLMDSEGLPVS<br>LPAAVDTHRQTLILPSHTLEYGNYTALAKVQIEGSVVYSNYCVGLE<br>VRAQAPVSVISEGTHLFFSRTTSSPIVLRGTQSFDPDDPGATLRYHW<br>ECATAGSPAHPCFDSSTAHQLDAAAPTVSFEAQWLSDSYDQFLVM<br>LRVSSGGRNSSETRVFLSPYPDSAFRFVHISWVSFKDTFVNWNDEL<br>SLQOAMCEDCSEIPNLSYSWDLFLVNATEKNRIEVPFCRVVGLLGSL<br>GLGAISESSQLNLLPTEPGTADPDATTTPFSREPSPVTLGQPATSAPR<br>GTPTEPMTGVYWIPPAGDSAVLGEAPEEGSLDLEPGPQSKGSLMT<br>GRSERSQPTHSPDPHLSDFEAYYSDIQEAIPSGGRQPAKDTSFPGSG<br>PSLSAEESPGDGDNLVDPSLSAGRAEPVLMIDWPKALLGRAVFQG |

TABLE 1-continued

| Protein name/SEQ ID NO. | Amino acid sequence |
|---|---|
| | YSSSGITEQTVTIKPYSLSSGETYVLQVSVASKHGLLGKAQLYLTV NPAPRDMACQVQPHHGLEAHTVFSVFCMSGKPDFHYEFSYQIGNT SKHTLYHGRDTQYYFVLPAGEHLDNYKVMVSTEITDGKGSKVQP CTVVVTVLPRYHGNDCLGEDLYNSSLKNLSTLQLMGSYTEIRNYIT VITRILSRLSKEDKTASCNQWSRIQDALISSVCRLAFVDQEEMIGSV LMLRDLVSFSNKLGFMSAVLILKYTRALLAQGQFSGPFVIDKGVRL ELIGLISRVWEVSEQENSKEEVYRHEEGITVISDLLLGCLSLNHVST GQMEFRTLLHYNLQSSVQSLGSVQVHLPGDLAGHSPAGAETQSPC YISQLILFKKNPYPGSQAPGQIGGVVGLNLYTCSSRRPINRQWLRKP VMVEFGEEDGLDNRRNKTTFVLLRDKVNLHQFTELSENPQESLQIE IEFSKPVTRAFPVMLLVRFSEKPTPSDFLVKQIYFWDESIVQIYIPAA SQKDASVGYLSLLDADYDRKPPNRYLAKAVNYTVHFQWIRCLFW DKREWKSERFSPQPGTSPEKVNCSYHRLAAFALLRRKLKASFEVS DISKLQSHPENLLPSIFIMGSVILYGFLVAKSRQVDHHEKKKAGYIF LQEASLPGHQLYAVVIDTGFRAPARLTSKVYIVLCGDNGLSETKEL SCPEKPLFERNSRHTFILSAPAQLGLLRKIRLWHDSRGPSPGWFISH VMVKELHTGQGWFFPAQCWLSAGRHDGRVERELTCLQGGLGFR KLFYCKFTEYLEDFHVWLSVYSRPSSSRYLHTPRLTVSFSLLCVYA CLTALVAAGGQEQPHLDVSPTLGSFRVGLLCTLLASPGAQLLSLLF RLSKEAPGSARVEPHSPLRGGAQTEAPHGPNSWGRIPDAQEPRKQP ASAILSGSGRAQRKAASDNGTACPAPKLQVHGADHSRTSLMGKSH CCPPHTQAPSSGLEGLMPQWSRALQPWWSSAVWAICGTASLACSL GTGFLAYRFGQEQCVQWLHLLSLSVVCCIFITQPLMVCLMALGFA WKRRADNHFFTESLCEATRDLDSELAERSWTRLPFSSSCSIPDCAG EVEKVLAARQQARHLRWAHPPSKAQLRGTQRMRRESRTRAALR DISMDILMLLLLLCVIYGRFSQDEYSLNQAIRKEFTRNARNCLGGL RNIADWWDWSLTTLLDGLYPGGTPSARVPGAQPGALGGKCYLIGS SVIRQLKVFPRHLCKPPRPFSALTEDSIPTCSPEVGGPENPYLIDPEN QNVTLNGPGGCGTREDCVLSLGRTRTEAHTALSRLRASMWIDRST RAVSVHFTLYNPPTQLFTSVSLRVEILPTGSLVPSSLVESFSIFRSDS ALQYHLMLPQLVFLALSLIHLCVQLYRMMDKGVLSYWRKPRNWL ELSVVGVSLTYYAVSGHLVTLAGDVTNQFHRGLCRAFMDLTLMA SWNQRARWLRGILLFLFTLKCVYLPGIQNTMASCSSMMRHSLPSIF VAGLVGALMLAALSHLRFLLSMWVLPPGTFTDAFPGLLFHFPRR SQKDCLLGLSKSDQRAMACYFGILLIVSATLCFGMLRGFLMTLPQ KRKSFQSKSFVRLKDVTAYMWEKVLTFLRLETPKLEEAEMVENH NYYLDEFANLLDELLMKINGLSDSLQLPLLEKTSNNTGEARTEESP LVDISSYQAAEPADIKDF |
| Cognate thermal shock protein 71 kDa or heat shock protein cognate 71 kDa (HSPA8) SEQ ID NO: 9 | MSKGPAVGIDLGTTYSCVGVFQHGKVEIIANDQGNRTTPSYVAFT DTERLIGDAAKNQVAMNPTNTVFDAKRLIGRRFDDAVVQSDMKH WPFMVVNDAGRPKVQVEYKGETKSFYPEEVSSMVLTKMKEIAEA YLGKTVTNAVVTVPAYFNDSQRQATKDAGTIAGLNVLRIINEPTA AAIAYGLDKKVGAERNVLIFDLGGGTFDVSILTIEDGIFEVKSTAGD THLGGEDFDNRMVNHFIAEFKRKHKKDISENKRAVRRLRTACERA KRTLSSSTQASIEIDSLYEGIDFYTSITRARFEELNADLFRGTLDPVE KALRDAKLDKSQIHDIVLVGGSTRIPKIQKLLQDFFNGKELNKSINP DEAVAYGAAVQAAILSGDKSENVQDLLLLDVTPLSLGIETAGGVM TVLIKRNTTIPTKQTQTFTTYSDNQPGVLIQVYEGERAMTKDNNLL GKFELTGIPPAPRGVPQIEVTFDIDANGILNVSAVDKSTGKENKITIT NDKGRLSKEDIERMVQEAEKYKAEDEKQRDKVSSKNSLESYAFN MKATVEDEKLQGKINDEDKQKILDKCNEIINWLDKNQTAEKEEFE HQQKELEKVCNPIITKLYQSAGGMPGGMPGGFPGGGAPPSGGASS GPTIEEVD |
| Anikirina-3 or Ankyrin-3 (ANK3) SEQ ID NO: 10 | MAHAASQLKKNRDLEINAEEEPEKKRKHRKRSRDRKKKSDANAS YLRAARAGHLEKALDYIKNGVDINICNQNGLNALHLASKEGHVEV VSELLQREANVDAATKKGNTALHIASLAGAQAEVVKLVTNGANV NAQSQNGFTPLYMAAQENHLEVVKFLLDNGASQSLATEDGFTPLA VALQQGHDQVVSLLLENDTKGKVRLPALHIAARKDDTKAAALLL QNDNNADVESKSGFTPLHIAAHYGNINVATLLLNRAAAVDFTARN DITPLHVASKRGNANMVKLLLDRGAKIDAKTRDGLTPLHCGARSG HEQVVEMLLDRAAPILSKTKNGLSPLHMATQGDHLNCVQLLLQH NVPVDDVTNDYLTALHVAAHCGHYKVAKVLLDKKANPNAKALN GFTPLHIACKKNRIKVMELLLKHGASIQAVTESGLTPIHVAAFMGH VNIVSQLMHHGASPNTTNVRGETALHMAARSGQAEVVRYLVQDG AQVEAKAKDDQTPLHISARLGKADIVQQLLQQGASPNAATTSGYT PLHLSAREGHEDVAAFLLDHGASLSITTKKGFTPLHVAAKYGKLE VANLLLQKSASPDAAGKSGLTPLHVAAHYDNQKVALLLLDQGAS PHAAAKNGYTPLHIAAKKNQMDIATTLLEYGADANAVTRQGIASV HLAAQEGHVDMVSLLLGRNANVNLSNKSGLTPLHLAAQEDRVNV AEVLVNQGAHVDAQTKMGYTPLHVGCHYGNIKIVNFLLQHSAKV NAKTKNGYTPLHQAAQQGHTHIINVLLQNNASPNELTVNGNTALG IARRLGYISVVDTLKIVTEETMTTTTVTEKHKMNVPETMNEVLDM SDDEVRKANAPEMLSDGEYISDVEEGEDAMTGDTDKYLGPQDLK ELGDDSLPAEGYMGFSLGARSASLRSFSSDRSYTLNRSSYARDSM MIEELLVPSKEQHLTFTREFDSDSLRHYSWAADTLDNVNLVSSPIH SGFLVSFMVDARGGSMRGSRHHGMRIIIPPRKCTAPTRITCRLVKR |

TABLE 1-continued

| Protein name/SEQ ID NO. | Amino acid sequence |
|---|---|
| | HKLANPPPMVEGEGLASRLVEMGPAGAQFLGPVIVEIPHFGSMRG
KERELIVLRSENGETWKEHQFDSKNEDLTELLNGMDEELDSPEELG
KKRICRIITKDFPQYFAVVSRIKQESNQIGPEGGILSSTTVPLVQASFP
EGALTKRIRVGLQAQPVPDEIVKKILGNKATFSPIVTVEPRRRKFHK
PITMTIPVPPPSGEGVSNGYKGDTTPNLRLLCSITGGTSPAQWEDIT
GTTPLTFIKDCVSFTTNVSARFWLADCHQVLETVGLATQLYRELIC
VPYMAKFVVFAKMNDPVESSLRCFCMTDDKVDKTLEQQENFEEV
ARSKDIEVLEGKPIYVDCYGNLAPLTKGGQQLVFNFYSFKENRLPF
SIKIRDTSQEPCGRLSFLKEPKTTKGLPQTAVCNLNITLPAHKKETE
SDQDDEIEKTDRRQSFASLALRKRYSYLTEPGMIERSTGATRSLPTT
YSYKPFFSTRPYQSWTTAPITVPGPAKSGFTSLSSSSSNTPSASPLKS
IWSVSTPSPIKSTLGASTTSSVKSISDVASPIRSFRTMSSPIKTVVSQS
PYNIQVSSGTLARAPAVTEATPLKGLASNSTFSSRTSPVTTAGSLLE
RSSITMTPPASPKSNINMYSSSLPFKSIITSAAPLISSPLKSVVSPVKS
AVDVISSAKITMASSLSSPVKQMPGHAEVALVNGSISPLKYPSSSTL
INGCKATATLQEKISSATNSVSSVVSAATDTVEKVFSTTTAMPFSPL
RSYVSAAPSAFQSLRTPSASALYTSLGSSISATTSSVTSSIITVPVYSV
VNVLPEPALKKLPDSNSFTKSAAALLSPIKTLTTETHPQPHFSRTSSP
VKSSLFLAPSALKLSTPSSLSSSQEILKDVAEMKEDLMRMTAILQTD
VPEEKPFQPELPKEGRIDDEEPFKIVEKVKEDLVKVSEILKKDVCVD
NKGSPKSPKSDKGHSPEDDWIEFSSEEIREARQQAAASQSPSLPERV
QVKAKAASEKDYNLTKVIDYLTNDIGSSSLTNLKYKFEDAKKDGE
ERQKRVLKPAIALQEHKLKMPPASMRTSTSEKELCKMADSFFGTD
TILESPDDFSQHDQDKSPLSDSGFETRSEKTPSAPQSAESTGPKPLFH
EVPIPPVITETRTEVVHVIRSYDPSAGDVPQTQPEEPVSPKPSPTFME
LEPKPTTSSIKEKVKAFQMKASSEEDDHNRVLSKGMRVKEETHITT
TTRMVYHSPPGGEGASERIEETMSVHDIMKAFQSGRDPSKELAGLF
EHKSAVSPDVHKSAAETSAQHAEKDNQMKPKLERIIEVHIEKGNQ
AEPTEVHRETKKHPEKEMYVYQKDLSRGDINLKDFLPEKHDAFPC
SEEQGQQEEEELTAEESLPSYLESSRVNTPVSQEEDSRPSSAQLISD
DSYKTLKLLSQHSIEYHDDELSELRGESYRFAEKMLLSEKLDVSHS
DIEESVTDHAGPPSSELQGSDKRSREKIATAPKKEILSKIYKDVSEN
GVGKVSKDEHFDKVTVLHYSGNVSSPKHAMWMRFTEDRLDRGR
EKLIYEDRVDRTVKEAEEKLTEVSQFFRDKTEKLNDELQSPEKKAR
PKNGKEYSSQSPTSSSPEKVLLTELLASNDEWVKARQHGPDGQGF
PKAEEKAPSLPSSPEKMVLSQQTEDSKSTVEAKGSISQSKAPDGPQ
SGFQLKQSKLSSIRLKFEQGTHAKSKDMSQEDRKSDGQSRIPVKKI
QESKLPVYQVFAREKQQKAIDLPDESVSVQKDFMVLKTKDEHAQS
NEIVVNDSGSDNVKKQRTEMSSKAMPDSFSEQQAKDLACHITSDL
ATRGPWDKKVFRTWESSGATNNKSQKEKLSHVLVHDVRENHIGH
PESKSVDQKNEFMSVTERERKLLTNGSLSEIKEMTVKSPSKKVLYR
EYVVKEGDHPGGLLDQPSRRSESSAVSHIPVRVADERRMLSSNIPD
GFCEQSAFPKHELSQKLSQSSMSKETVETQHFNSIEDEKVTYSEISK
VSKHQSYVGLCPPLEETETSPTKSPDSLEFSPGKESPSSDVFDHSPID
GLEKLAPLAQTEGGKEIKTLPVYVSFVQVGKQYEKEIQQGGVKKII
SQECKTVQETRGTFYTTRQQKQPPSPQGSPEDDTLEQVSPLDSSGK
SPLTPETPSSEEVSYEFTSKTPDSLIAYIPGKPSPIPEVSEESEEEEQA
KSTSLKQTTVEETAVEREMPNDVSKDSNQRPKNNRVAYIEFPPPPP
LDADQIESDKKHHYLPEKEVDMIEVNLQDEHDKYQLAEPVIRVQP
PSPVPPGADVSDSSDDESIYQPVPVKKYTFKLKEVDDEQKEKPKAS
AEKASNQKELESNGSGKDNEFGLGLDSPQNEIAQNGNNDQSITECS
IATTAEFSHDTDATEIDSLDGYDLQDEDDGLTESDSKLPIQAMEIKK
DIWNTEGILKPADRSFSQSKLEVIEEEGKVGPDEDKPPSKSSSSEKT
PDKTDQKSGAQFFTLEGRHPDRSVFPDTYFSYKVDEEFATPFKTVA
TKGLDFDPWSNNRGDDEVFDSKSREDETKPFGLAVEDRSPATTPD
TTPARTPTDESTPTSEPNPFPFHEGKMFEMTRSGAIDMSKRDFVEE
RLQFFQIGEHTSEGKSGDQGEGDKSMVTATPQPQSGDTTVETNLE
RNVETPTVEPNPSIPTSGECQEGTSSSGSLEKSAAATNTSKVDPKLR
TPIKMGISASTMTMKKEGPGEITDKIEAVMTSCQGLENETITMISNT
ANSQMGVRPHEKHDFQKDNFNNNNNLDSSTIQTDNIMSNIVLTEH
SAPTCTTEKDNPVKVSSGKKTGVLQGHCVRDKQKVLGEQQKTE
LIGIRQKSKLPIKATSPKDTFPPNHMSNTKASKMKQVSQSEKTKAL
TTSSCVDVKSRIPVKNTHRDNIIAVRKACATQKQGQPEKGKAKQL
PSKLPVKVRSTCVTTTTTTATTTTTTTTTTTSCTVKVRKSQLKEV
CKHSIEYFKGISGETLKLVDRLSEEEKKMQSELSDEEESTSRNTSLS
ETSRGGQPSVTTKSARDKKTEAAPLKSKSEKAGSEKRSSRRTGPQS
PCERTDIRMAIVADHLGLSWTELARELNFSVDEINQIRVENPNSLIS
QSFMLLKKWVTRDGKNATTDALTSVLTKINRIDIVTLLEGPIFDYG
NISGTRSFADENNVFHDPVDGWQNETSSGNLESCAQARRVTGGLL
DRLDDSPDQCRDSITSYLKGEAGKFEANGSHTEITPEAKTKSYFPES
QNDVGKQSTKETLKPKIHGSGHVEEPASPLAAYQKSLEETSKLIIEE
TKPCVPVSMKKMSRTSPADGKPRLSLHEEEGSSGSEQKQGEGFKV
KTKKEIRHVEKKSHS |
| Rho 23<br>or Rho GTPase-activating protein 23<br>(ARHGAP23)<br>SEQ ID NO: 11 | MNGVAFCLVGIPPRPEPRPPQLPLGPRDGCSPRRPFPWQGPRTLLL
YKSPQDGFGFTLRHFIVYPPESAVHCSLKEEENGGRGGGPSPRYRL
EPMDTIFVKNVKEDGPAHRAGLRTGDRLVKVNGESVIGKTYSQVI
ALIQNSDDTLELSIMPKDEDILQLAYSQDAYLKGNEPYSGEARSIPE |

TABLE 1-continued

| Protein name/SEQ ID NO. | Amino acid sequence |
|---|---|
| | PPPICYPRKTYAPPARASTRATMVPEPTSALPSDPRSPAAWSDPGLR
VPPAARAHLDNSSLGMSQPRPSPGAFPHLSSEPRTPRAFPEPGSRVP
PSRLECQQALSHWLSNQVPRRAGERRCPAMAPRARSASQDRLEEV
AAPRPWPCSTSQDALSQLGQEGWHRARSDDYLSRATRSAEALGPG
ALVSPRFERCGWASQRSSARTPACPTRDLPGPQAPPPSGLQGLDDL
GYIGYRSYSPSFQRRTGLLHALSFRDSPFGGLPTFNLAQSPASFPPE
ASEPPRVVRPEPSTRALEPPAEDRGDEVVLRQKPPTGRKVQLTPAR
QMNLGFGDESPEPEASGRGERLGRKVAPLATTEDSLASIPFIDEPTS
PSIDLQAKHVPASAVVSSAMNSAPVLGTSPSSPTFTFTLGRHYSQD
CSSIKAGRRSSYLLAITTERSKSCDDGLNTFRDEGRVLRRLPNRIPS
LRMLRSFFTDGSLDSWGTSEDADAPSKRHSTSDLSDATFSDIRREG
WLYYKQILTKKGKKAGSGLRQWKRVYAALRARSLSLSKERREPG
PAAAGAAAAGAGEDEAAPVCIGSCLVDISYSETKRRHVFRLTTAD
FCEYLFQAEDRDDMLGWIRAIRENSRAEGEDPGCANQALISKKLN
DYRKVSHSSGPKADSSPKGSRGLGGLKSEFLKQSAARGLRTQDLP
AGSKDDSAAAPKTPWGINIIKKNKKAAPRAFGVRLEECQPATENQ
RVPLIVAACCRIVEARGLESTGIYRVPGNNAVVSSLQEQLNRGPGD
INLQDERWQDLNVISSLLKSFFRKLPEPLFTDDKYNDFIEANRIEDA
RERMRTLRKLIRDLPGHYYETLKFLVGHLKTIADHSEKNKMEPRN
LALVFGPTLVRTSEDNMTDMVTHMPDRYKIVETLIQHSDWFFSDE
EDKGERTPVGDKEPQAVPNIEYLLPNIGRTVPPGDPGSDSTTCSSAK
SKGSWAPKKEPYAREMLAISFISAVNRKRKKRREARGLGSSTDDD
SEQEAHKPGAGATAPGTQERPQGPLPGAVAPEAPGRLSPPAAPEER
PAADTRSIVSGYSTLSTMDRSVCSGASGRRAGAGDEADDERSELS
HVETDTEGAAGAGPGGRLTRRPSFSSHHLMPCDTLARRRLARGRP
DGEGAGRGGPRAPEPPGSASSSSQESLRPPAAALASRPSRMEALRL
RLRGTADDMLAVRLRRPLSPETRRRRSSWRRHTVVVQSPLTDLNF
NEWKELGGGGPPEPAGARAHSDNKDSGLSSLESTKARAPSSAASQ
PPAPGDTGSLQSQPPRRSAASRLHQCL |
| Cytoskeletal Keratin 78 type II
or Keratin, type II cytoskeletal 78
(KRT78)
SEQ ID NO: 12 | MSLSPCRAQRGFSARSACSARSRGRSRGGFSSRGGFSSRSLNSFGG
CLEGSRGSTWGSGGRLGVRFGEWSGGPGLSLCPPGGIQEVTINQNL
LTPLKIEIDPQFQVVRTQETQEIRTLNNQFASFIDKVRFLEQQNKVL
ETKWHLLQQQGLSGSQQGLEPVFEACLDQLRKQLEQLQGERGAL
DAELKACRDQEEEYKSKYEEEAHRRATLENDFVVLKKDVDGVFL
SKMELEGKLEALREYLYFLKHLNEEELGQLQTQASDTSVVLSMDN
NRYLDFSSIIILVRARYEEIARSSKAEAEALYQTKYQELQVSAQLH
GDRMQETKVQISQLHQEIQRLQSQIENLKKQNASLQAAITDAEQR
GELALKDAQAKVDELEAALRMAKQNLARLLCEYQELTSTKLSLD
VEIATYRRLLEGEECRMSGECTSQVTISSVGGSAVMSGGVGGGLG
STCGLGSGKGSPGSCCTSIVTGGSNIILGSGKDPVLDSCSVSGSSAG
SSCHTILKKTVESSLKTSITY |
| Alpha-3 collagen chain (VI)
or Collagen type VI, alpha 3
(COL6A3)
SEQ ID NO: 13 | MRKHRHLPLVAVFCLFLSGFPTTHAQQQQADVKNGAAADIIFLVD
SSWTIGEEHFQLVREFLYDVVKSLAVGENDFHFALVQFNGNPHTE
FLLNTYRTKQEVLSHISNMSYIGGTNQTGKGLEYIMQSHLTKAAGS
RAGDGVPQVIVVLTDGHSKDGLALPSAELKSADVNVFAIGVEDAD
EGALKEIASEPLNMHMFNLENFTSLHDIVGNLVSCVHSSVSPERAG
DIETLKDITAQDSADIIFLIDGSNNTGSVNFAVILDFLVNLLEKLPIG
TQQIRVGVVQFSDEPRTMFSLDTYSTKAQVLGAVKALGFAGGELA
NIGLALDFVVENHFTRAGGSRVEEGVPQVLVLISAGPSSDEIRYGV
VALKQASVFSFGLGAQAASRAELQHIATDDNLVFTVPEFRSFGDLQ
EKLLPYIVGVAQRHIVLKPPTIVTQVIEVNKRDIVFLVDGSSALGLA
NFNAIRDFIAKVIQRLEIGQDLIQVAVAQYADTVRPEFYFNTHPTKR
EVITAVRKMKPLDGSALYTGSALDFVRNNLFTSSAGYRAAEGIPKL
LVLITGGKSLDEISQPAQELKRSSIMAFAIGNKGADQAELEEIAFDS
SLVFIPAEFRAAPLQGMLPGLLAPLRTLSGTPEVHSNKRDIIFLLDGS
ANVGKTNFPYVRDFVMNLVNSLDIGNDNIRVGLVQFSDTPVTEFS
LNTYQTKSDILGHLRQLQLQGGSGLNTGSALSYVYANHFTEAGGS
RIREHVPQLLLLLTAGQSEDSYLQAANALTRAGILTFCVGASQANK
AELEQIAFNPSLVYLMDDFSSLPALPQQLIQPLTTYVSGGVEEVPLA
QPESKRDILFLFDGSANLVGQFPVVRDFLYKIIDELNVKPEGTRIAV
AQYSDDVKVESRFDEHQSKPEILNLVKRMKIKTGKALNLGYALDY
AQRYIFVKSAGSRIEDGVLQFLVLLVAGRSSDRVDGPASNLKQSGV
VPFIFQAKNADPAELEQIVLSPAFILAAESLPKIGDLHPQIVNLLKSV
HNGAPAPVSGEKDVVFLLDGSEGVRSGFPLLKEFVQRVVESLDVG
QDRVRVAVVQYSDRTRPEFYLNSYMNKQDVVNAVRQLTLLGGPT
PNTGAALEFVLRNILVSSAGSRITEGVPQLLIVLTADRSGDDVRNPS
VVVKRGGAVPIGIGIGNADITEMQTISFIPDFAVAIPTFRQLGTVQQ
VISERVTQLTREELSRLQPVLQPLPSPGVGGKRDVVFLIDGSQSAGP
EFQYVRTLIERLVDYLDVGFDTTRVAVIQFSDDPKVEFLLNAHSSK
DEVQNAVQRLRPKGGRQINVGNALEYVSRNIFKRPLGSRIEEGVPQ
FLVLISSGKSDDEVDDPAVELKQFGVAPFTIARNADQEELVKISLSP
EYVFSVSTFRELPSLEQKLLTPITTLTSEQIQKLLASTRYPPPAVESD
AADIVFLIDSSEGVRPDGFAHIRDFVSRIVRRLNIGPSKVRVGVVQF
SNDVFPEFYLKTYRSQAPVLDAIRRLRLRGGSPLNTGKALEFVARN
LFVKSAGSRIEDGVPQHLVLVLGGKSQDDVSRFAQVIRSSGIVSLG
VGDRNIDRTELQTITNDPRLVFTVREFRELPNIEERIMNSFGPSAATP |

TABLE 1-continued

| Protein name/SEQ ID NO. | Amino acid sequence |
|---|---|
| | APPGVDTPPPSRPEKKKADIVFLLDGSINFRRDSFQEVLRFVSEIVD
TVYEDGDSIQVGLVQYNSDPTDEFFLKDFSTKRQIIDAINKVVYKG
GRHANTKVGLEHLRVNHFVPEAGSRLDQRVPQIAFVITGGKSVED
AQDVSLALTQRGVKVFAVGVRNIDSEEVGKIASNSATAFRVGNVQ
ELSELSEQVLETLHDAMHETLCPGVTDAAKACNLDVILGFDGSRD
QNVFVAQKGFESKVDAILNRISQMHRVSCSGGRSPTVRVSVVANT
PSGPVEAFDFDEYQPEMLEKFRNMRSQHPYVLTEDTLKVYLNKFR
QSSPDSVKVVIHFTDGADGDLADLHRASENLRQEGVRALILVGLE
RVVNLERLMHLEFGRGFMYDRPLRLNLLDLDYELAEQLDNIAEKA
CCGVPCKCSGQRGDRGPIGSIGPKGIPGEDGYRGYPGDEGGPGERG
PPGVNGTQGFQGCPGQRGVKGSRGFPGEKGEVGEIGLDGLDGEDG
DKGLPGSSGEKGNPGRRGDKGPRGEKGERGDVGIRGDPGNPGQDS
QERGPKGETGDLGPMGVPGRDGVPGGPGETGKNGGFGRRGPPGA
KGNKGGPGQPGFEGEQGTRGAQGPAGPAGPPGLIGEQGISGPRGS
GGAAGAPGERGRTGPLGRKGEPGEPGPKGGIGNRGPRGETGDDGR
DGVGSEGRRGKKGERGFPGYPGPKGNPGEPGLNGTTGPKGIRGRR
GNSGPPGIVGQKGDPGYPGPAGPKGNRGDSIDQCALIQSIKDKCPC
CYGPLECPVFPTELAFALDTSEGVNQDTFGRMRDVVLSIVNDLTIA
ESNCPRGARVAVVTYNNEVTTEIRFADSKRKSVLLDKIKNLQVAL
TSKQQSLETAMSFVARNTFKRVRNGFLMRKVAVFFSNTPTRASPQ
LREAVLKLSDAGITPLFLTRQEDRQLINALQINNTAVGHALVLPAG
RDLTDFLENVLTCHVCLDICNIDPSCGFGSWRPSFRDRRAAGSDVD
IDMAFILDSAETTTLFQFNEMKKYIAYLVRQLDMSPDPKASQHFAR
VAVVQHAPSESVDNASMPPVKVEFSLTDYGSKEKLVDFLSRGMTQ
LQGTRALGSAIEYTIENVFESAPNPRDLKIVVLMLTGEVPEQQLEEA
QRVILQAKCKGYFFVVLGIGRKVNIKEVYTFASEPNDVFFKLVDKS
TELNEEPLMRFGRLLPSFVSSENAFYLSPDIRKQCDWFQGDQPTKN
LVKFGHKQVNVPNNVTSSPTSNPVTTTKPVTTTKPVTTTTKPVTTT
TKPVTIINQPSVKPAAAKPAPAKPVAAKPVATKMATVRPPVAVKP
ATAAKPVAAKPAAVRPPAAAAAKPVATKPEVPRPQAAKPAATKP
ATTKPMVKMSREVQVFEITENSAKLHWERAEPPGPYFYDLTVTSA
HDQSLVLKQNLTVTDRVIGGLLAGQTYHVAVVCYLRSQVRATYH
GSFSTKKSQPPPPQPARSASSSTINLMVSTEPLALTETDICKLPKDEG
TCRDFILKWYYDPNTKSCARFWYGGCGGNENKFGSQKECEKVCA
PVLAKPGVISVMGT |
| Beta subunit of proteasome type-5
or Proteasome subunit beta type-5
(PSMB5)
SEQ ID NO: 14 | MALASVLERPLPVNQRGFFGLGGRADLLDLGPGSLSDGLSLAAPG
WGVPEEPGIEMLHGTTTLAFKFRHGVIVAADSRATAGAYIASQTV
KKVIEINPYLLGTMAGGAADCSFWERLLARQCRIYELRNKERISVA
AASKLLANMVYQYKGMGLSMGTMICGWDKRGPGLYYVDSEGNR
ISGATFSVGSGSVYAYGVMDRGYSYDLEVEQAYDLARRAIYQATY
RDAYSGGAVNLYHVREDGWIRVSSDNVADLHEKYSGSTP |
| Heterogeneous nuclear
ribonucleoproteins A2/B1
(HNRNPA2B1)
SEQ ID NO: 15 | MEKTLETVPLERKKREKEQFRKLFIGGLSFETTEESLRNYYEQWGK
LTDCVVMRDPASKRSRGFGFVTFSSMAEVDAAMAARPHSIDGRV
VEPKRAVAREESGKPGAHVTVKKLFVGGIKEDTEEHHLRDYFEEY
GKIDTIEIITDRQSGKKRGFGFVTFDDHDPVDKIVLQKYHTINGHNA
EVRKALSRQEMQEVQSSRSRGGGNFGFGDSRGGGGNFGPGPGSNF
RGGSDGYGSGRGFGDGYNGYGGGPGGGNFGGSPGYGGGRGGYG
GGGPGYGNQGGYGGGYDNYGGGNYGSGNYNDFGNYNQQPSN
YGPMKSGNFGGSRNMGGPYGGGNYGPGGSGGSGGYGGRSRY |
| Histone H2B type 1-B
(HIST1H2BB)
SEQ ID NO: 16 | MPEPSKSAPAPKKGSKKAITKAQKKDGKKRKRSRKESYSIYVYKV
LKQVHPDTGISSKAMGIMNSFVNDIFERIAGEASRLAHYNKRSTITS
REIQTAVRLLLPGELAKHAVSEGTKAVTKYTSSK |
| homolog of DnaJ subfamily C member
13
or DnaJ homolog subfamily C member
13
(DNAJC13)
SEQ ID NO: 17 | MNIIRENKDLACFYTTKHSWRGKYKRVFSVGTHAITTYNPNTLEV
TNQWPYGDICSISPVGKGQGTEFNLTFRKGSGKKSETLKFSIEHRT
ELLTEALRFRTDFSEGKITGRRYNCYKHHWSDSRKPVILEVTPGGF
DQINPATNRVLCSYDYRNIEGFVDLSDYQGGFCILYGGFSRLHLFA
SEQREEIIKSAIDHAGNYIGISLRIRKEPLEFEQYLNLRFQKYSTDESI
TSLAEFVVQKISPRHSEPVKRVLALTETCLVERDPATYNIATLKPLG
EVFALVCDSENPQLFTIEFIKGQVRKYSSTERDSLLASLLDGVRASG
NRDVCVKMTPTHKGQRWGLLSMPVDEEVESLHLRFLATPPNGNF
ADAVFRFNANISYSGVLHAVTQDGLFSENKEKLINNAITALLSQEG
DVVASNAELESQFQAVRRLVASKAGFLAFTQLPKFRERLGVKVVK
ALKRSNNGIIHAAVDMLCALMCPMHDDYDLRQEQLNKASLLSSK
KFLENLLEKFNSHVDHGTGALVISSLLDFLTFALCAPYSETTEGQQF
DMLLEMVASNGRTLFKLFQHPSMAIIKGAGLVMKAIIEEGDKEIAT
KMQELALSEGALPRHLHTAMFTISSDQRMLTNRQLSRHLVGLWTA
DNATATNLLKRILPPGLLAYLESSDLVPEKDADRMHVRDNVKIAM
DQYGKFNKVPEWQRLAGKAAKEVEKFAKEKVDLVLMHWRDRM
GIAQKENINQKPVVLRKRRQRIKIEANWDLFYYRFGQDHARSNLI
WNFKTREELKDTLESEMRAFNIDRELGSANVISWNHHEFEVKYEC
LAEEIKIGDYYLRLLLEEDENEESGSIKRSYEFFNELYHRFLLTPKV
NMKCLCLQALAIVYGRCHEEIGPFTDTRYIIGMLERCTDKLERDRLI
LFLNKLILNKKNVKDLMDSNGIRILVDLLTLAHLHVSRATVPLQSN
VIEAAPDMKRESEKEWYFGNADKERSGPYGFHEMQELWTKGML |

TABLE 1-continued

| Protein name/SEQ ID NO. | Amino acid sequence |
|---|---|
| | NAKTRCWAQGMDGWRPLQSIPQLKWCLLASGQAVLNETDLATLI<br>LNMLITMCGYFPSRDQDNAIIRPLPKVKRLLSDSTCLPHIIQLLLTFD<br>PILVEKVAILLYHIMQDNPQLPRLYLSGVFFFIMMYTGSNVLPVAR<br>FLKYTHTKQAFKSEETKGQDIFQRSILGHILPEAMVCYLENYEPEKF<br>SEIFLGEFDTPEAIWSSEMRRLMEEKIAAHLADFTPRLQSNTRALYQ<br>YCPIPIINYPQLENELFCNIYYLKQLCDTLRFPDWPIKDPVKLLKDTL<br>DAWKKEVEKKPPMMSIDDAYEVLNLPQGQGPHDESKIRKAYFRL<br>AQKYHPDKNPEGRDMFEKVNKAYEFLCTKSAKIVDGPDPENIILIL<br>KTQSILFNRHKEDLQPYKYAGYPMLIRTITMETSDDLLFSKESPLLP<br>AAIELAFHTVNCSALNAEELRRENGLEVLQEAFSRCVAVLTRASK<br>PSDMSVQVCGYISKCYSVAAQFEECREKITEMPSIIKDLCRVLYFG<br>KSIPRVAALGVECVSSFAVDFWLQTHLFQAGILWYLLGFLFNYDY<br>TLEESGIQKSEETNQQEVANSLAKLSVHALSRLGGYLAEEQATPEN<br>PTIRKSLAGMLTPYVARKLAVASVTEILKMLNSNTESPYLIWNNST<br>RAELLEFLESQQENMIKKGDCDKTYGSEFVYSDHAKELIVGEIFVR<br>VYNEVPTFQLEVPKAFAASLLDYIGSQAQYLHTFMAITHAAKVESE<br>QHGDRLPRVEMALEALRNVIKYNPGSESECIGHFKLIFSLLRVHGA<br>GQVQQLALEVVNIVTSNQDCVNNIAESMVLSSLLALLHSLPSSRQL<br>VLETLYALTSSTKIIKEAMAKGALIYLLDMFCNSTHPQVRAQTAEL<br>FAKMTADKLIGPKVRITLMKFLPSVFMDAMRDNPEAAVHIFEGTH<br>ENPELIWNDNSRDKVSTTVREMMLEHFKNQQDNPEANWKLPEDF<br>AVVFGEAEGELAVGGVFLRIFIAQPAWVLRKPREFLIALLEKLFELL<br>EKNNPHGETLETLTMATVCLFSAQPQLADQVPPLGHLPKVIQAMN<br>HRNNAIPKSAIRVIHALSENELCVRAMASLETIGPLMNGMKKRADT<br>VGLACEAINRMFQKEQSELVAQLKADLVPYLLKLLEGIGLENLD<br>SPAATKAQIVKALKAMTRSLQYGEQVNEILCRSSVWSAFKDQKHD<br>LFISESQTAGYLTGPGVAGYLTAGTSTSVMSNLPPPVDHEAGDLGY<br>QT |
| Beta enolase<br>(ENO3)<br>SEQ ID NO: 18 | MAMQKIFAREILDSRGNPTVEVDLHTAKGRFAAVPSGASTGIYE<br>ALELRDGDKGRYLGKGVLKAVENINNTLGPALLQKKLSVVDQEK<br>VDKFMIELDGTENKSKFGANAILGVSLAVCKAGAAEKGVPLYRHI<br>ADLAGNPDLILPVPAFNVINGGSHAGNKLAMQEFMILPVGASSFKE<br>AMRIGAEVYHHLKGVIKAKYGKDATNVGDEGGFAPNILENNEAL<br>ELLKTAIQAAGYPDKVVIGMDVAASEFYRNGKYDLDFKSPDDPAR<br>HITGEKLGELYKSFIKNYPVVSIEDPFDQDDWATWTSFLSGVNIQIV<br>GDDLTVTNPKRIAQAVEKKACNCLLLKVNQIGSVTESIQACKLAQS<br>NGWGVMVSHRSGETEDTFIADLVVGLCTGQIKTGAPCRSERLAKY<br>NQLMRIEEALGDKAIFAGRKFRNPKAK |
| Glutathione S-transferase P<br>(GSTP1)<br>SEQ ID NO: 19 | MPPYTVVYFPVRGRCAALRMLLADQGQSWKEEVVTVETWQEGS<br>LKASCLYGQLPKFQDGDLTLYQSNTILRHLGRTLGLYGKDQQEAA<br>LVDMVNDGVEDLRCKYISLIYTNYEAGKDDYVKALPGQLKPFETL<br>LSQNQGGKTFIVGDQISFADYNLLDLLLIHEVLAPGCLDAFPLLSAY<br>VGRLSARPKLKAFLASPEYVNLPINGNGKQ |
| Glutathione 5-transferase Mu 3<br>(GSTM3)<br>SEQ ID NO: 20 | MSCESSMVLGYWDIRGLAHAIRLLLEFTDTSYEEKRYTCGEAPDY<br>DRSQWLDVKFKLDLDFPNLPYLLDGKNKITQSNAILRYIARKHNM<br>CGETEEEKIRVDIIENQVMDFRTQLIRLCYSSDHEKLKPQYLEELPG<br>QLKQFSMFLGKFSWFAGEKLTFVDFLTYDILDQNRIFDPKCLDEFP<br>NLKAFMCRFEALEKIAAYLQSDQFCKMPINNKMAQWGNKPVC |
| Farnesyl pyrophosphate synthase<br>Variant 2<br>SEQ ID NO: 21 | MPLSRWLRSVGVFLLPAPYWAPRERWLGSLRRPSLVHGYPVLAW<br>HSARCWCQAWTEEPRALCSSLRMNGDQNSDVYAQEKQDFVQHFS<br>QIVRVLTEDEMGHPEIGDAIARLKEVLEYNAIGGKYNRGLTVVVA<br>FRELVEPRKQDADSLQRAWTVGWCVELLQAFFLVADDIMDSSLTR<br>RGQICWYQKPGVGLDAINDANLLEACIYRLLKLYCREQPYYLNLIE<br>LFLQSSYQTEIGQTLDLLTAPQGNVDLVRFTEKRYKSIVKYKTAFY<br>SFYLPIAAAMYMAGIDGEKEHANAKKILLEMGEFFQIQDDYLDLF<br>GDPSVTGKIGTDIQDNKCSWLVVQCLQRATPEQYQILKENYGQKE<br>AEKVARVKALYEELDLPAVFLQYEEDSYSHIMALIEQYAAPLPPAV<br>FLGLARKIYKRRK |
| Farnesyl pyrophosphate synthase<br>Variant 3<br>SEQ ID NO: 22 | MNGDQNSDVYAQEKQDFVQHFSQIVRVLTEDEMGHPEIGDAIARL<br>KEVLEYNAIGGKYNRGLTVVVAFRELVEPRKQDADSLQRAWTVG<br>WCVELLQAFFLVADDIMDSSLTRRGQICWYQKPGVGLDAINDANL<br>LEACIYRLLKLYCREQPYYLNLIELFLQSSYQTEIGQTLDLLTAPQG<br>NVDLVRFTEKRYKSIVKYKTAFYSFYLPIAAAMYMAGIDGEKEHA<br>NAKKILLEMGEFFQIQDDYLDLFGDPSVTGKIGTDIQDNKCSWLVV<br>QCLQRATPEQYQILKENYGQKEAEKVARVKALYEELDLPAVFLQY<br>EEDSYSHIMALIEQYAAPLPPAVFLGLARKIYKRRK |
| Farnesyl pyrophosphate synthase<br>Variant 4<br>SEQ ID NO: 23 | MNGDQNSDVYAQEKQDFVQHFSQIVRVLTEDEMGHPEIGDAIARL<br>KEVLEYNAIGGKYNRGLTVVVAFRELVEPRKQDADSLQRAWTVG<br>WCVELLQAFFLVADDIMDSSLTRRGQICWYQKPGVGLDAINDANL<br>LEACIYRLLKLYCREQPYYLNLIELFLQSSYQTEIGQTLDLLTAPQG<br>NVDLVRFTEKRYKSIVKYKTAFYSFYLPIAAAMYMAGIDGEKEHA<br>NAKKILLEMGEFFQIQDDYLDLFGDPSVTGKIGTDIQDNKCSWLVV |

TABLE 1-continued

| Protein name/SEQ ID NO. | Amino acid sequence |
|---|---|
| | QCLQRATPEQYQILKENYGQKEAEKVARVKALYEELDLPAVFLQY EEDSYSHIMALIEQYAAPLPPAVFLGLARKIYKRRK |
| Farnesyl pyrophosphate synthase Variant 5 SEQ ID NO: 24 | MDSSLTRRGQICWYQKPGVGLDAINDANLLEACIYRLLKLYCREQ PYYLNLIELFLQSSYQTEIGQTLDLLTAPQGNVDLVRFTEKRYKSIV KYKTAFYSFYLPIAAAMYMAGIDGEKEHANAKKILLEMGEFFQIQ DDYLDLFGDPSVTGKIGTDIQDNKCSWLVVQCLQRATPEQYQILK ENYGQKEAEKVARVKALYEELDLPAVFLQYEEDSYSHIMALIEQY AAPLPPAVFLGLARKIYKRRK |
| Farnesyl pyrophosphate synthase Variant 6 SEQ ID NO: 25 | MNGDQNSDVYAQEKQDFVQHFSQIVRVLTEDEMGHPEIGDAIARL KEVLEYNAIGGKYNRGLTVVVAFRELVEPRKQDADSLQRAWTVG WCVELLQAFFLVADDIMDSSLTRRGQICWYQKPGVGLDAINDANL LEACIYRLLKLYCREQPYYLNLIELFLQSSYQTEIGQTLDLLTAPQG NVDLVRFTEKRYKSIVKYKTAFYSFYLPIAAAMYMAGIDGEKEHA NAKKILLEMGEFFQIQDDYLDLFGDPSVTGKIGTDIQDNKCSWLVV QCLQRATPEQYQILKENYGQKEAEKVARVKALYEELDLPAVFLQY EEDSYSHIMALIEQYAAPLPPAVFLGLARKIYKRRK |
| Farnesyl pyrophosphate synthase Variant 7 SEQ ID NO: 26 | MPLSRWLRSVGVFLLPAPYWAPRERWLGSLRRPSLVHGYPVLAW HSARCWCQAWTEEPRALCSSLRMNGDQNSDVYAQEKQDFVQHFS QIVRVLTEDEMGHPEIGDAIARLKEVLEYNAIGGKYNRGLTVVVA FRELVEPRKQDADSLQRAWTVGWCVELLQAFFLVADDIMDSSLTR RGQICWYQKPGVGLDAINDANLLEACIYRLLKLYCREQPYYLNLIE LFLQSSYQTEIGQTLDLLTAPQGNVDLVRFTEKRYKSIVKYKTAFY SFYL |
| Farnesyl pyrophosphate synthase Variant 8 SEQ ID NO: 27 | MPLSRWLRSVGVFLLPAPYWAPRERWLGSLRRPSLVHGYPVLAW HSARCWCQAWTEEPRALCSSLRMNGDQNSDVYAQEKQDFVQHFS QIVRVLTEDEMGHPEIGDAIARLKEVLEYNAIGGKYNRGLTVVVA FRELVEPRKQDADSLQRAWTVGWCVELLQAFFLVADDIMDS |
| Neurofibromin 1 Variant 2 SEQ ID NO: 28 | MAAHRPVEWVQAVVSRFDEQLPIKTGQQNTHTKVSTEHNKECLIN ISKYKFSLVISGLTTILKNVNNMRIFGEAAEKNLYLSQLIILDTLEKC LAGQPKDTMRLDETMLVKQLLPEICHFLHTCREGNQHAAELRNSA SGVLFSLSCNNFNAVFSRISTRLQELTVCSEDNVDVHDIELLQYINV DCAKLKRLLKETAFKFKALKKVAQLAVINSLEKAFWNWVENYPD EFTKLYQIPQTDMAECAEKLFDLVDGFAESTKRKAAVWPLQIILLI LCPEIIQDISKDVVDENNMNKKLFLDSLRKALAGHGGSRQLTESAA IACVKLCKASTYINWEDNSVIFLLVQSMVVDLKNLLFNPSKPFSRG SQPADVDLMIDCLVSCFRISPHNNQHFKICLAQNSPSTFHYVLVNS LHRIITNSALDWWPKIDAVYCHSVELRNMFGETLHKAVQGCGAHP AIRMAPSLTFKEKVTSLKFKEKPTDLETRSYKYLLLSMVKLIHADP KLLLCNPRKQGPETQGSTAELITGLVQLVPQSHMPEIAQEAMEALL VLHQLDSIDLWNPDAPVETFWEISSQMLFYICKKLTSHQMLSSTEIL KWLREILICRNKFLLNKQADRSSCHFLLFYGVGCDIPSSGNTSQM SMDHEELLRTPGASLRKGKGNSSMDSAAGCSGTPPICRQAQTKLE VALYMFLWNPDTEAVLVAMSCFRHLCEEADIRCGVDEVSVHNLL PNYNTFMEFASVSNMMSTGRAALQKRVMALLRRIEHPTAGNTEA WEDTHAKWEQATKLILNYPKAKMEDGQAAESLHKTIVKRRMSHV SGGGSIDLSDTDSLQEWINMTGFLCALGGVCLQQRSNSGLATYSPP MGPVSERKGSMISVMSSEGNADTPVSKFMDRLLSLMVCNHEKVG LQIRTNVKDLVGLELSPALYPMLFNKLKNTISKFFDSQGQVLLTDT NTQFVEQTIAIMKNLLDNHTEGSSEHLGQASIETMMLNLVRYVRV LGNMVHAIQIKTKLCQLVEVMMARRDDLSFCQEMKFRNKMVEYL TDWVMGTSNQAADDDVKCLTRDLDQASMEAVVSLLAGLPLQPEE GDGVELMEAKSQLFLKYFTLFMNLLNDCSEVEDESAQTGGRKRG MSRRLASLRHCTVLAMSNLLNANVDSGLMHSIGLGYHKDLQTRA TFMEVLTKILQQGIEFDTLAETVLADRFERLVELVTMMGDQGELPI AMALANVVPCSQWDELARVLVTLFDSRHLLYQLLWNMFSKEVEL ADSMQTLFRGNSLASKIMTFCFKVYGATYLQKLLDPLLRIVITSSD WQHVSFEVDPTRLEPSESLEENQRNLLQMTEKFFHAIISSSSEFPPQ LRSVCHCLYQVVSQRFPQNSIGAVGSAMFLRFINPAIVSPYEAGILD KKPPPRIERGLKLMSKILQSIANHVLFTKEEHMRPFNDFVKSNFDA ARRFFLDIASDCPTSDAVNHSLSFISDGNVLALHRLLWNNQEKIGQ YLSSNRDHKAVGRRPFDKMATLLAYLGPPEHKPVADTHWSSLNL TSSKFEEFMTRHQVHEKEEFKALKTLSIFYQAGTSKAGNPIFYVA RRFKTGQINGDLLIYHVLLTLKPYYAKPYEIVVDLTHTGPSNRFKT DFLSKWFVVFPGFAYDNVSAVYIYNCNSWVREYTKYHERLLTGL KGSKRLVFIDCPGKLAEHIEHEQQKLPAATLALEEDLKVFHNALKL AHKDTKVSIKVGSTAVQVTSAERTKVLGQSVFLNDIYYASEIEEICL VDENQFTLTIANQGTPLTFMHQECEAIVQSIIHIRTRWELSQPDSIPQ HTKIRPKDVPGTLLNIALLNLGSSDPSLRSAAYNLLCALTCTFNLKI EGQLLETSGLCIPANNTLFIVSISKTLAANEPHLTLEFLEECISGFSKS SIELKHLCLEYMTPWLSNLVRFCKHNDDAKRQRVTAILDKLITMTI NEKQMYPSIQAKIWGSLGQITDLLDVVLDSFIKTSATGGLGSIKAE VMADTAVALASGNVKLVSSKVIGRMCKIIDKTCLSPTPTLEQHLM WDDIAILARYMLMLSFNNSLDVAAHLPYLFHVVTFLVATGPLSLR TABLE 1-continued

| Protein name/SEQ ID NO. | Amino acid sequence |
|---|---|
| | ASTHGLVINIIHSLCTCSQLHFSEETKQVLRLSLTEFSLPKFYLLFGIS KVKSAAVIAFRSSYRDRSFSPGSYERETFALTSLETVTEALLEIMEA CMRDIPTCKWLDQWTELAQRFAFQYNPSLQPRALVVFGCISKRVS HGQIKQIIRILSKALESCLKGPDTYNSQVLIEATVIALTKLQPLLNKD SPLHKALFWVAVAVLQLDEVNLYSAGTALLEQNLHTLDSLRIFND KSPEEVFMAIRNPLEWHCKQMDHFVGLNFNSNFNFALVGHLLKG YRHPSPAIVARTVRILHTLLTLVNKHRNCDKFEVNTQSVAYLAALL TVSEEVRSRCSLKHRKSLLLTDISMENVPMDTYPIHHGDPSYRTLK ETQPWSSPKGSEGYLAATYPTVGQTSPRARKSMSLDMGQPSQANT KKLLGTRKSFDHLISDTKAPKRQEMESGITTPPKMRRVAETDYEM ETQRISSSQQHPHLRKVSVSESNVLLDDEEVLTDPKIQALLLTVLATL VKYTTDEFDQRILYEYLAEASVVFPKVFPVVHNLLDSKINTLLSLC QDPNLLNPIHGIVQSVVYHEESPPQYQTSYLQSFGFNGLWRFAGPF SKQTQIPDYAELIVKFLDALIDTYLPGIDEETSEESLLTPTSPYPPAL QSQLSITANLNLSNSMTSLATSQHSPGIDKENVELSPTTGHCNSGRT RHGSASQVQKQRSAGSFKRNSIKKIV |
| Neurofibromin 1 Variant 3 SEQ ID NO: 29 | MAAHRPVEWVQAVVSRFDEQLPIKTGQQNTHTKVSIEHNKECLIN ISKYKFSLVISGLTTILKNVNNMRIFGEAAEKNLYLSQLIILDTLEKC LAGQPKDTMRLDETMLVKQLLPEICHFLHTCREGNQHAAELRNSA SGVLFSLSCNNFNAVFSRISTRLQELTVCSEDNVDVHDIELLQYINV DCAKLKRLLKETAFKFKALKKVAQLAVINSLEKAFWNWVENYPD EFTKLYQIPQTDMAECAEKLFDLVDGFAESTKRKAAVWPLQIILLI LCPEIIQDISKDVVDENNMNKKLFLDSLRKALAGHGGSRQLTESAA IACVKLCKASTYINWEDNSVIFLLVQSMVVDLKNLLFNPSKPFSRG SQPADVDLMIDCLVSCFRISPHNNQHFKICLAQNSPSTFHYVLVNS LHRIITNSALDWWPKIDAVYCHSVELRNMFGETLHKAVQGCGAHP AIRMAPSLTFKEKVTSLKFKEKPTDLETRSYKYLLLSMVKLIHADP KLLLCNPRKQGPETQGSTAELITGLVQLVPQSHMPEIAQEAMEALL VLHQLDSIDLWNPDAPVETFWEIRYMYFYFLNSTFKFYFVFLS |
| Neurofibromin 1 Variant 4 SEQ ID NO: 30 | NWEDNSVIFLLVQSMVVDLKNLLFNPSKPFSRGSQPADVDLMIDC LVSCFRISPHNNQHFKICLAQNSPSTFHYVLVNSLHRIITNSALDWW PKIDAVYCHSVELRNMFGETLHKAVQGCGAHPAIRMAPSLTFKEK VTSLKFKEKPTDLETRSYKYLLLSMVKLIHADPKLLLCNPRKQGPE TQGSTAELITGLVQLVPQSHMPEIAQEAMEALLVLHQLDSIDLWNP DAPVETFWEISSQMLFYICKKLTSHQMLSSTEILKWLREILICRNKF LLKNKQADRSSCHFLLFYGVGCDIPSSGNTSQMSMDHEELLRTPG ASLRKGKGNSSMDSAAGCSGTPPICRQAQTKLEVALYMFLWNPDT EAVLVAMSCFRHLCEEADIRCGVDEVSVHNLLPNYNTFMEFASVS NMMSTGRAALQKRVMALLRRIEHPTAGNTEAWEDTHAKWEQAT KLILNYPKAKMEDGQAAESLHKTIVKRRMSHVSGGGSIDLSDTDS LQEWINMTGFLCALGGVCLQQRSNSGLATYSPPMGPVSERKGSMI SVMSSEGNADTPVSKFMDRLLSLMVCNHEKVGLQIRTNVKDLVG LELSPALYPMLFNKLKNTISKFFDSQGQVLLTDTNTQFVEQTIAIMK NLLDNHTEGSSEHLGQASIETMMLNLVRYVRVLGNMVHAIQIKTK LCQLVEVMMARRDDLSFCQEMKFRNKMVEYLTDWVMGTSNQA ADDDVKCLTRDLDQASMEAVVSLLAGLPLQPEEGDGVELMEAKS QLFLKYFTLFMNLLNDCSEVEDESAQTGGRKRGMSRRLASLRHCT VLAMSNLLNANVDSGLMHSIGLGYHKDLQTRATFMEVLTKILQQ GTEFDTLAETVLADRFERLVELVTMMGDQGELPIAMALANVVPCS QWDELARVLVTLFDSRHLLYQLLWNMFSKEVELADSMQTLFRGN SLASKIMTFCFKVYGATYLQKLLDPLLRIVITSSDWQHVSFEVDPT RLEPSESLEENQRNLLQMTEKFFHAIISSSSEFPPQLRSVCHCLYQV VSQRFPQNSIGAVGSAMFLRFINPAIVSPYEAGILDKKPPPRIERGLK LMSKILQSIANHVLFTKEEHMRPFNDFVKSNFDAARRFFLDIASDC PTSDAVNHSLSFISDGNVLALHRLLWNNQEKIGQYLSSNRDHKAV GRRPFDKMATLLAYLGPPEHKPVADTHWSSLNLTSSKFEEFMTRH QVHEKEEFKALKTLSIFYQAGTSKAGNPIFYYVARRFKTGQINGDL LIYHVLLTLKPYYAKPYEIVVDLTHTGPSNRFKTDFLSKWFVVFPG FAYDNVSAVYIYNCNSWVREYTKYHERLLTGLKGSKRLVFIDCPG KLAEHIEHEQQKLPAATLALEEDLKVFHNALKLAHKDTKVSIKVG STAVQVTSAERTKVLGQSVFLNDIYYASEIEEICLVDENQFTLTIAN QGTPLTFMHQECEAIVQSIIHIRTRWELSQPDSIPQHTKIRPKDVPGT LLNIALLNLGSSDPSLRSAAYNLLCALTCTFNLKIEGQLLETSGLCIP ANNTLFIVSISKTLAANEPHLTLEFLEECISGFSKSSIELKHLCLEYM TPWLSNLVRFCKHNDDAKRQRVTAILDKLITMTINEKQMYPSIQA KIWGSLGQITDLLDVVLDSFIKTSATGGLGSIKAEVMADTAVALAS GNVKLVSSKVIGRMCKIIDKTCLSPTPTLEQHLMWDDIAILARYML MLSFNNSLDVAAHLPYLFHVVTFLVATGPLSLRASTHGLVINIIHSL CTCSQLHFSEETKQVLRLSLTEFSLPKFYLLFGISKVKSAAVIAFRSS YRDRSFSPGSYERETFALTSLETVTEALLEIMEACMRDIPTCKWLD QWTELAQRFAFQYNPSLQPRALVVFGCISKRVSHGQIKQIIRILSKA LESCLKGPDTYNSQVLIEATVIALTKLQPLLNKDSPLHKALFWVAV AVLQLDEVNLYSAGTALLEQNLHTLDSLRIFNDKSPEEVFMAIRNP LEWHCKQMDHFVGLNFNSNFNFALVGHLLKGYRHPSPAIVARTV RILHTLLTLVNKHRNCDKFEVNTQSVAYLAALLTVSEEVRSRCSLK HRKSLLLTDISMENVPMDTYPIHHGDPSYRTLKETQPWSSPKGSEG |

TABLE 1-continued

| Protein name/SEQ ID NO. | Amino acid sequence |
|---|---|
| | YLAATYPTVGQTSPRARKSMSLDMGQPSQANTKKLLGTRKSFDHL ISDTKAPKRQEMESGITTPPKMRRVAETDYEMETQRISSSQQHPHL RKVSVSESNVLLDEEVLTDPKIQALLLTVLATLVKYTTDEFDQRIL YEYLAEASVVFPKVFPVVHNLLDSKINTLLSLCQDPNLLNPIHGIVQ SVVYHEESPPQYQTSYLQSFGFNGLWRFAGPFSKQTQIPDYAELIV KFLDALIDTYLPGIDEETSEESLLTPTSPYPPALQSQLSITANLNLSNS MTSLATSQHSPASLPCSKSAVFMQLFPHQGIDKENVELSPTTGHCN SGRTRHGSASQVQKQRSAGSFKRNSIKKIV |
| Neurofibromin 1 Variant 5 SEQ ID NO: 31 | MAAHRPVEWVQAVVSRFDEQLPIKTGQQNTHTKVSTEHNKECLIN ISKYKFSLVISGLTTILKNVNNMRIFGEAAEKNLYLSQLIILDTLEKC LAGQPKDTMRLDETMLVKQLLPEICHFLHTCREGNQHAAELRNSA SGVLFSLSCNNFNAVFSRISTRLQELTVCSEDNVDVHDIELLQYINV DCAKLKRLLKETAFKFKALKKVAQLAVINSLEKAFWNWVENYPD EFTKLYQIPQTDMAECAEKLFDLVDGFAESTKRKAAVWPLQIILLI LCPEIIQDISKDVVDENNMNKKLFLDSLRKALAGHGGSRQLTESAA IACVKLCKASTYINWEDNSVIFLLVQSMVVDLKNLLFNPSKPFSRG SQPADVDLMIDCLVSCFRISPHNNQHFKICLAQNSPSTFHYVLVNS LHRIITNSALDWWPKIDAVYCHSVELRNMFGETLHKAVQGCGAHP AIRMAPSLTFKEKVTSLKFKEKPTDLETRSYKYLLLSMVKLIHADP KLLLCNPRKQGPETQGSTAELITGLVQLVPQSHMPEIAQEAMEVRG K |
| Neurofibromin 1 Variant 6 SEQ ID NO: 32 | MHQECEAIVQSIIHIRTRWELSQPDSIPQHTKIRPKDVPGTLLNIALL NLGSSDPSLRSAAYNLLCALTCTFNLKIEGQLLETSGLCIPANNTLFI VSISKTLAANEPHLTLEFLEECISGFSKSSIELKHLCLEYMTPWLSNL VRFCKHNDDAKRQRVTAILDKLITMTINEKQMYPSIQAKIWGSLG QITDLLDVVLDSFIKTSATGGLGSIKAEVMADTAVALASGNVKLVS SK |
| Neurofibromin 1 Variant 7 SEQ ID NO: 33 | MKRCWSNSCCQKSAIFFTPVVKETSMQLNFGILPLGFYFLSAATTS MQSLVAFLPETAFKFKALKKVAQLAVINSLEKAFWNWVENYPDE FTKLYQIPQTDMAECAEKLFDLVDGFAESTKRKAAVWPLQIILLIL CPEIIQDISKDVVDENNMNKVRRAKLFPLYLDVKQFILLKVCITLGL LFKQSISGNHLNDHFRFLCLMDLEETYSYIILFGRGKIIPGNEQRFKII P |
| Neurofibromin 1 Variant 8 SEQ ID NO: 34 | XIHGIVQSVVYHEESPPQYQTSYLQSFGFNGLWRFAGPFSKQTQIP DYAELIVKFLDALIDTYLPGIDEETSEESLLTPTSPYPPALQSQLSITA NLNLSNSMTSLATSQHSPGQ |
| Glyceraldehyde-3 phosphate dehydrogenase Variant 2 SEQ ID NO: 35 | MVYMFQYDSTHGKFHGTVKAENGKLVINGNPITIFQERDPSKIKW GDAGAEYVVESTGVFTTMEKAGAHLQGGAKRVIISAPSADAPMFV MGVNHEKYDNSLKIISNASCTTNCLAPLAKVIHDNFGIVEGLMTTV HAITATQKTVDGPSGKLWRDGRGALQNIIPASTGAAKAVGKVIPEL NGKLTGMAFRVPTANVSVVDLTCRLEKPAKYDDIKKVVKQASEG PLKGILGYTEHQVVSSDFNSDTHSSTFDAGAGIALNDHFVKLISWY DNEFGYSNRVVDLMAHMASKE |
| Glyceraldehyde-3 phosphate dehydrogenase Variant 3 SEQ ID NO: 36 | MGKVKVGVNGFGRIGRLVTRAAFNSGKVDIVAINDPFIDLNYMVY MFQYDSTHGKFHGTVKAENGKLVINGNPITIFQERDPSKIKWGDA GAEYVVESTGVFTTMEKAGAHLQGGAKRVIISAPSADAPMFVMG VNHEKYDNSLKIISNASCTTNCLAPLAKVIHDNFGIVEGLMTTVHA ITATQKTVDGPSGKLWRDGRGALQNIIPASTGAAKAVGKVIPELNG KLTGMAFRVPTANVSVVDLTCRLEKPAKYDDIKKVVKQASEGPL KGILGYTEHQVVSSDFNSDTHSSTFDAGAGIALNDHFVKLISWYDN EFGYSNRVVDLMAHMASKE |
| Glyceraldehyde-3 phosphate dehydrogenase Variant 4 SEQ ID NO: 37 | MGKVKVGVNGFGRIGRLVTRAAFNSGKVDIVAINDPFIDLNYMVY MFQYDSTHGKFHGTVKAENGKLVINGNPITIFQERDPSKIKWGDA GAEYVVESTGVFTTMEKAGAHLQGGAKRVIISAPSADAPMFVMG VNHEKYDNSLKIISNASCTTNCLAPLAKVIHDNFGIVEGLMTTVHA ITATQKTVDGPSGKLWRDGRGALQNIIPASTGAAKAVGKVIPELNG KLTGMAFRVPTANVSVVDLTCRLEKPAKYDDIKKVVKQASEGPL KGILGYTEHQVVSSDFNSDTHSSTFDAGAGIALNDHFVKLISWYDN EFGYSNRVVDLMAHMASKE |
| Glyceraldehyde-3 phosphate dehydrogenase Variant 5 SEQ ID NO: 38 | MEEMRDPSKIKWGDAGAEYVVESTGVFTTMEKAGAHLQGGAKR VIISAPSADAPMFVMGVNHEKYDNSLKIISNASCTTNCLAPLAKVIH DNFGIVEGLMTTVHAITATQKTVDGPSGKLWRDGRGALQNIIPAST GAAKAVGKVIPELNGKLTGMAFRVPTANVSVVDLTCRLEKPAKY DDIKKVVKQASEGPLKGILGYTEHQVVSSDFNSDTHSSTFDAGAGI ALNDHFVKLISWYDNEFGYSNRVVDLMAHMASKE |
| Glyceraldehyde-3 phosphate dehydrogenase Variant 6 SEQ ID NO: 39 | MVYMFQYDSTHGKFHGTVKAENGKLVINGNPITIFQERDPSKIKW GDAGAEYVVESTGVFTTMEKAGAHLQGGAKRVIISAPSADAPMFV MGVNHEKYDNSLKIISNASCTTNCLAPLAKVIHDNFGIVEGLMTTV HAITATQKTVDGPSGKLWRDGRGALQNIIPASTGAAKAVGKVIPEL |

TABLE 1-continued

| Protein name/SEQ ID NO. | Amino acid sequence |
|---|---|
| | NGKLTGMAFRVPTANVSVVDLTCRLEKPAKYDDIKKVVKQASEG PLKGILGYTEHQVVSSDFNSDTHSSTFDAGAGIALNDHFVKLISWY DNEFGYSNRVVDLMAHMASKE |
| Fibronectin Type III Domain Containing protein 1 Variant 2 SEQ ID NO: 40 | XPRHVKLLSTKMGLKVTWDPPKDATSRPVEHYNIAYGKSLKSLKY IKVNAETYSFLIEDVEPGVVYFVLLTAENHSGVSRPVYRAESPPGG EWIEIDGFPIKGPGPFNETVTEKEVPNKPLRVRVRSSDDRLSVAWK APRLSGAKSPRRSRGFLLGYGESGRKMNYVPLTRDERTHEIKKLAS ESVYVVSLQSMNSQGRSQPVYRAALTKRKISEEDELDVPDDISRV MSSQSVLVSWVDPVLEKQKKVVASRQYTVRYREKGELARWDYK QIANRRVLIENLIPDTVYEFAVRISQGERDGKWSTSVFQRTPESAPT TAPENLNVWPVNGKPTVVAASWDALPETEGKVKASKADVEQNTE DNGKPEKPEPSSPSPRAPASSQHPSVPASPQGRNAKDLLLDLKNKIL ANGGAPRKPQLRAKKAEELDLQSTEITGEEELGSREDSPMSPSDTQ DQKRTLRPPSRHGHSVVAPGRTAVRARMPALPRREGVDKPGFSLA TQPRPGAPPSASASPAHHASTQGTSHRPSLPASLNDNDLVDSDEDE RAVGSLHPKGAFAQPRPALSPSRQSPSSVLRDRSSVHPGAKPASPA RRTPHSGAAEEDSSASAPPSRLSPPHGGSSRLLPTQPHLSSPLSKGG KDGEDAPATNSNAPSRSTMSSSVSSHLSSRTQVSEGAEASDGESHG DGDREDGGRQAEATAQTLRARPASGHFHLLRHKPFAANGRSPSRF SIGRGPRLQPSSSPQSTVPSRAHPRVPSHSDSHPKLSSGIHGDEEDEK PLPATVVNDHVPSSSRQPISRGWEDLRRSPQRGASLHRKEPIPENPK STGADTHPQGKYSSLASKAQDVQQSTDADTEGHSPKAQPGSTDRH ASPARPPAARSQQHPSVPRRMTPGRAPQQQPPPPVATSQHHPGPQS RDAGRSPSQPRLSLTQAGRPRPTSQGRSHSSSDPYTASSRGMLPTA LQNQDEDAQGSYDDDSTEVEAQDVRAPAHAARAKEAAASLPKHQ QVESPTGAGAGGDHRSQRGHAASPARPSRPGGPQSRARVPSRAAP GKSEPPSKRPLSSKSQQSVSAEDDEEEDAGFFKGGKEDLLSSSVPK WPSSSTPRGGKDADGSLAKEEREPAIALAPRGGSLAPVKRPLPPPP GSSPRASHVPSRLPPRSAATVSPVAGTHPWPQYTTRAPPGHFSTTP MLSLRQRMMHARFRNPLSRQPARPSYRQGYNGRPNVEGKVLPGS NGKPNGQRIINGPQGTKWVVDLDRGLVLNAEGRYLQDSHGNPLRI KLGGDGRTIVDLEGTPVVSPDGLPLFGQGRHGTPLANAQDKPILSL GGKPLVGLEVIKKTTHPPTTTMQPTTTTTPLPTTTTPRPTTATTRRT TTTRRTTTRRPTTTVRTTTRTTTTTTPTPTTPIPTCPPGTLERHDDDG NLIMSSNGIPECYAEEDEFSGLETDTAVPTEEAYVIYDEDYEFETSR PPTTTEPSTTATTPRVIPEEGAISSFPEEEFDLAGRKRFVAPYVTYLN KDPSAPCSLTDALDHFQVDSLDEIIPNDLKKSDLPPQHAPRNITVVA VEGCHSFVIVDWDKATPGDVVTGYLVYSASYEDFIRNKWSTQASS VTHLPIENLKPNTRYYFKVQAQNPHGYGPISPSVSFVTESDNPLLV VRPPGGEPIWIPFAFKHDPSYTDCHGRQYVKRTWYRKFVGVVLCN SLRYKIYLSDNLKDTFYSIGDSWGRGEDHCQFVDSHLDRGTGPQS YVEALPTIQGYYRQYRQEPVRFGNIGFGTPYYYVGWYECGVSIPG KW |
| Eukaryotic initiation factor 4A-I Variant 2 SEQ ID NO: 41 | MSASQDSRSRDNGPDGMEPEGVIESNWNEIVDSFDDMNLSESLLR GIYAYGFEKPSAIQQRAILPCIKGYDVIAQAQSGTGKTATFAISILQQ IELDLKATQALVLAPTRELAQQIQKVVMALGDYMGASCHACIGGT NVRAEVQKLQMEAPHIIVGTPGRVFDMLNRRYLSPKYIKMFVLDE ADEMLSRGFKDQIYDIFQKLNSNTQVVLLSATMPSDVLEVTKKFM RDPIRILVKKEELTLEGIRQFYINVEREEWKLDTLCDLYETLTITQA VIFINTRRKVDWLTEKMHARDFTVSAMHGDMDQKERDVIMREFR SGSSRVLITTDLLGKLYPQNRSRWTVWP |
| Eukaryotic initiation factor 4A-I Variant 3 SEQ ID NO: 42 | MSASQDSRSRDNGPDGMEPEGVIESNWNEIVDSFDDMNLSESLLR GIYAYGFEKPSAIQQRAILPCIKGYDVIAQAQSGTGKTATFAISILQQ IELDLKATQALVLAPTRELAQQIQKVVMALGDYMGASCHACIGGT NVRAEVQKLQMEAPHIIVGTPGRVFDMLNRRYLSPKYIKMFVLDE ADEMLSRGFKDQIYDIFQKLNSNTQVVLLSATMPSDVLEVTKKFM RDPIRILVKKEELTLEGIRQFYINVEREEWKLDTLCDLYETLTITQA VIFINTRRKVDWLTEKMHARDFTVSAMHGDMDQKERDVIMREFR SGSSRVLITTDLLNRSRWTVWP |
| Eukaryotic initiation factor 4A-I Variant 4 SEQ ID NO: 43 | MEPEGVIESNWNEIVDSFDDMNLSESLLRGIYAYGFEKPSAIQQRAI LPCIKGYDVIAQAQSGTGKTATFAISILQQIELDLKATQALVLAPTR ELAQQIQKVVMALGDYMGASCHACIGGTNVRAEVQKLQMEAPHI IVGTPGRVFDMLNRRYLSPKYIKMFVLDEADEMLSRGFKDQIYDIF QKLNSNTQVVLLSATMPSDVLEVTKKFMRDPIRILVKKEELTLEGI RQFYINVEREEWKLDTLCDLYETLTIT |
| Eukaryotic initiation factor 4A-I Variant 5 SEQ ID NO: 44 | XVVMALGDYMGASCHACIGGTNVRAEVQKLQMEAPHIIVGTPGR VFDMLNRRYLSPKYIKMFVLDEADEMLSRGFKDQIYDIFQKLNSN TQVVLLSATMPSDVLEVTKKFMRDPIRILVKKEELTLEGIRQFYINV EREEWKLDTLCDLYETLTITQAVIFINTRRKVDWLTEKMHARDFT VSAMHGDMDQKERDVIMREFRSGSSRVLITTDLLGKLYPQNRSRW TVWP |

TABLE 1-continued

| Protein name/SEQ ID NO. | Amino acid sequence |
|---|---|
| Eukaryotic initiation factor 4A-I Variant 6 SEQ ID NO: 45 | MSASQDSRSRDNGPDGMEPEGVIESNWNEIVDSFDDMNLSESLLR GIYAYGFEKPSAIQQRAILPCIKGYDVIAQAQSGTGKTATFAISILQQ IELDLKATQALVLAPTRELAQQKVVMALGDYMGASCHACIGGTN VRAEVQKLQMEAPHIIVGTPGRVFDMLNRRYLSPKYIKMFVLDEA DEMLSRGFKDQIYDIFQKLNSNTQVVLLSATMPSDVLEVTKKFMR DPIRILVKKEELTLEGIRQFYINVEREEWKLDTLCDLYETLTITQAVI FINTRRKVDWLTEKMHARDFTVSAM |
| Eukaryotic initiation factor 4A-I Variant 7 SEQ ID NO: 46 | MSASQDSRSRDNGPDGMEPEGVIESNWNEIVDSFDDMNLSESLLR GIYAYGFEKPSAIQQRAILPCIKGYDVIAQAQSGTGKTATFAISILQQ IELDLKATQALVLAPTRELAQQIQKVVMALGDYMGASCHACIGGT NVRAEVQKLQMEAPHIIVGTPGRVFDMLNRRYLSPKYIKMFVLDE ADEMLSRGFKDQIYDIFQKLNSNTQEELTLEGIRQFYINVEREEWK LDTLCDLYETLTITQAVIFINTRRKVDWLTEKMHARDFTVSA |
| Eukaryotic initiation factor 4A-I Variant 8 SEQ ID NO: 47 | MEPEGVIESNWNEIVDSFDDMNLSESLLRGIYAYGFEKPSAIQQRAI LPCIKGYDVIAQAQSGTGKTATFAISILQQIELDLKAT |
| Eukaryotic initiation factor 4A-I Variant 9 SEQ ID NO: 48 | XAWAHCARGRHRPRPPTSGSRDNGPDGMEPEGVIESNWNEIVDSF DDMNLSESLLRGIYAYGFEKPSAIQQRAILPCIKGYDVIAQAQSGTG KTATFAISILQQIELDLKATQALVLAPTRELAQQIQKVVMALGDYM GASCHACIGGTNVRAEVQKLQMEAPHIIVGTPGRVFDMLNRRYLS PKYIKMFVLDEADEMLSRGFKDQIYDIFQKL |
| Eukaryotic initiation factor 4A-I Variant 10 SEQ ID NO: 49 | MSASQDSRDNGPDGMEPEGVIESNWNEIVDSFDDMNLSESLLRGI YAYGFEKPSAIQQRAILPCIKGYDVIAQAQSGTGKTATFAISILQQIE LDLKATQALVLAPTRELAQQIQKVVMALGDYMGASCHACIGGTN VRAEVQKLQMEAPHIIVGTPGRVFDMLNRRYLSPKYIKMFVLDEA DEMLS |
| Eukaryotic initiation factor 4A-I Variant 11 SEQ ID NO: 50 | MNLSESLLRGIYAYGFEKPSAIQQRAILPCIKGYDVIAQAQSGTGKT ATFAISILQQIELDLKATQALVLAPTRELAQQIQKVVMALGDYMG ASCHACIGGTNVRAEVQKLQMEAPHIIVGTPGRVFDMLNRRYLSP KYIKMFVLDEADEMLSRGFKDQIYDI |
| Eukaryotic initiation factor 4A-I Variant 12 SEQ ID NO: 51 | MNLSESLLRGIYAYGFEKPSAIQQRAILPCIKGYDVIAQAQSGTGKT ATFAISILQQIELDLKATQALVLAPTRELAQQIQKVVMALGDYMG ASCHACIGGTNVRAEVQKLQMEAPHIIVGTPGRVFDMLNRRY |
| Eukaryotic initiation factor 4A-I Variant 13 SEQ ID NO: 52 | MFVLDEADEMLSRGFKDQIYDIFQKLNSNTQVVLLSATMPSDVLE VTKKFMRDPIRILVKKEELTLEGIRQFYINVEREEWKLDTLCDLYE TLTITQAVIFINTRRKVDWLTEKMHA |
| Eukaryotic initiation factor 4A-I Variant 14 SEQ ID NO: 53 | MGRSTFLRGSRDNGPDGMEPEGVIESNWNEIVDSFDDMNLSESLL RGIYAYGFEKPSAIQQRAILPCIKGYDVIAQAQSGTGKTA |
| L-lactate dehydrogenase chain B Variant 2 SEQ ID NO: 54 | MATLKEKLIAPVAEEEATVPNNKITVVGVGQVGMACAISILGKSLA DELALVDVLEDKLKGEMMDLQHGSLFLQTPKIVADKDYSVTANS KIVVVTAGVRQQEGESRLNLVQRNVNVFKFIIPQIVKYSPDCIIIVVS NPVDILTYVTWKLSGLPKHRVIGSGCNLDSARFRYLMAEKLGIHPS SCHGWILGEHGDSSVAVWSGVNVAGVSLQELNPEMGTDNDSEN WKEVHKMVVESAYEVIKLKGYTNWAIGLSVADLIESMLKNLSRIH PVSTMVKGMYGIENEVFLSLPCILNARGLTSVINQKLKDDEVAQLK KSADTLWDIQKDLKDL |
| L-lactate dehydrogenase chain B Variant 3 SEQ ID NO: 55 | MATLKEKLIAPVAEEEATVPNNKITVVGVGQVGMACAISILGKSLA DELALVDVLEDKLKGEMMDLQHGSLFLQTPKIVADKDYSVTANS KIVVVTAGVRQQEGESRLNLVQRNVNVFKFIIPQIVKYSPDCIIIVVS NPVDILTYVTWKLSGLPKHRVIGSGCNLDSARFRYLMAEKLGIHPS SCHGWILGEHGDSSVAVWSGVNVAGVSLQELNPEMGTDNDSEN WKEVHKMVVESAYEVIKLKGYTNWAIGLSVADLIESMLKNLSRIH PVSTMVKGMYGIENEVFLSLPCILNARGLTSVINQKLKDDEVAQLK KSADTLWDIQKDLKDLXLVSSRL |
| L-lactate dehydrogenase chain B Variant 4 SEQ ID NO: 56 | MATLKEKLIAPVAEEEATVPNNKITVVGVGQVGMACAISILGKSLA DELALVDVLEDKLKGEMMDLQHGSLFLQTPKIVADKDYSVTANS KIVVVTAGVRQQEGESRLNLVQRNVNVFKFIIPQIVKYSPDCIIIVVS NPVDILTYVTWKLSGLPKHRVIGSGCNLDSARFRYLMAEKLGIHPS SCHGWILGEHGDSSVAVWSGVNVAGVSLQELNPEMGTDNDSEN WKEVH |
| L-lactate dehydrogenase chain B Variant 5 SEQ ID NO: 57 | MATLKEKLIAPVAEEEATVPNNKITVVGVGQVGMACAISILGKSLA DELALVDVLEDKLKGEMMDLQHGSLFLQTPKIVADKDYSVTANS KIVVVTAGVRQQEGESRLNLVQRNVNVFKFIIPQIVKYSPDCIIIV |

TABLE 1-continued

| Protein name/SEQ ID NO. | Amino acid sequence |
|---|---|
| L-lactate dehydrogenase chain B<br>Variant 6<br>SEQ ID NO: 58 | MATLKEKLIAPVAEEEATVPNNKITVVGVGQVGMACAISILGKSLA<br>DELALVDVLEDKLKGEMMDLQHGSLFLQTPKIVADKDYSVTANS<br>KIVVVTAGVRQQ |
| Nuclear heterogeneous<br>Ribonucleoprotein A1<br>Variant 2<br>SEQ ID NO: 59 | MSKSESPKEPEQLRKLFIGGLSFETTDESLRSHFEQWGTLTDCVVM<br>RDPNTKRSRGFGFVTYATVEEVDAAMNARPHKVDGKIEVIEIM<br>SREDSQRPGAHLTVKKIFVGGIKEDTEEHHLRDYFEQYGKIEVIEIM<br>TDRGSGKKRGFAFVTFDDHDSVDKIVIQKYHTVNGHNCEVRKALS<br>KQEMASASSSQRGRSGSGNFGGSRGGGFGGNDNFGRGGNFSGRG<br>GFGGSRGGGGYGGSGDYNGFGNDGSNFGGGGSYNDFGNYNNQ<br>SSNFGPMKGGNFGGRSSGPYGGGGQYFAKPRNQGGYGGSSSSSSY<br>GSGRRF |
| Nuclear heterogeneous<br>Ribonucleoprotein A1<br>Variant 3<br>SEQ ID NO: 60 | MSKSESPKEPEQLRKLFIGGLSFETTDESLRSHFEQWGTLTDCVVM<br>RDPNTKRSRGFGFVTYATVEEVDAAMNARPHKVDGRVVEPKRAV<br>SREDSQRPGAHLTVKKIFVGGIKEDTEEHHLRDYFEQYGKIEVIEIM<br>TDRGSGKKRGFAFVTFDDHDSVDKIVIQKYHTVNGHNCEVRKALS<br>KQEMASASSSQRGRSGSGNFGGGSYNDFGNYNNQSSNFGPMKGG<br>NFGGRSSGPYGGGGQYFAKPRNQGGYGGSSSSSSYGSGRRF |
| Nuclear heterogeneous<br>Ribonucleoprotein A1<br>Variant 4<br>SEQ ID NO: 61 | MSKSESPKEPEQLRKLFIGGLSFETTDESLRSHFEQWGTLTDCVVM<br>RDPNTKRSRGFGFVTYATVEEVDAAMNARPHKVDGRVVEPKRAV<br>SREDSQRPGAHLTVKKIFVGGIKEDTEEHHLRDYFEQYGKIEVIEIM<br>TDRGSGKKRGFAFVTFDDHDSVDKIVIQKYHTVNGHNCEVRKALS<br>KQEMASASSSQRGRSGSGNFGGSRGGGFGGNDNFGRGGNFSGRG<br>IGDGYNGFGNDGSNFGGGGSYNDFGNYNNQSSNFGPMKGGNFGG<br>RSSGPYGGGGQYFAKPRNQGGYGGSSSSSSYGSGRRF |
| Nuclear heterogeneous<br>Ribonucleoprotein A1<br>Variant 5<br>SEQ ID NO: 62 | KIEVIEIMTDRGSGKKRGFAFVTFDDHDSVDKIVIQKYHTVNGHNC<br>EVRKALSKQEMASASSSQRGRSGSGNFGGGRGGGFGGNDNFGRG<br>GNFSGRGGFGGSRGGGGYGGSGDYNGFGNDGSNFGGGGSYNDF<br>GNYNNQSSNFGPMKGGNFGGRSSGPYGGGGQYFAKPRNQGGYG<br>GSSSSSSYGSGRRF |
| Nuclear heterogeneous<br>Ribonucleoprotein A1<br>Variant 6<br>SEQ ID NO: 63 | MRDSLLVAKFLGTQDLCLFLNLALSPKEPEQLRKLFIGGLSFETTDE<br>SLRSHFEQWGTLTDCVVMRDPNTKRSRGFGFVTYATVEEVDAAM<br>NARPHKVDGRVVEPKRAVSREDSQRPGAHLTVKKIFVGGIKEDTE<br>EHHLRDYFEQYGKIEVIEIMTDRGSGKKRGFAFVTFDDHDSVDKIV<br>IQKYHTVNGHNCEVRKALSKQEMASASSSQRGRSGSGNFGGGRG<br>GGFGG |
| Nuclear heterogeneous<br>Ribonucleoprotein A1<br>Variant 7<br>SEQ ID NO: 64 | MRDPNTKRSRGFGFVTYATVEEVDAAMNARPHKVDGRVVEPKR<br>AVSREDSQRPGAHLTVKKIFVGGIKEDTEEHHLRDYFEQYGKIEVI<br>EIMTDRGSGKKRGFAFVTFDDHDS |
| Nuclear heterogeneous<br>Ribonucleoprotein A1<br>Variant 8<br>SEQ ID NO: 65 | MSKSESPKEPEQLRKLFIGGLSFETTDESLRSHFEQWGTLTDCVVM<br>RDPNTKRSRGFGFVTYATVEEVDAAMNARPHKVDGRVVEPKRAV<br>SREDSQRPGAHLTVKKIFVGGFGGSRGGGGYGGSGDYNGFGND<br>GSNFGGGGSYNDFGNYNNQSSN |
| Nuclear heterogeneous<br>Ribonucleoprotein A1<br>Variant 9<br>SEQ ID NO: 66 | MSKSESPKEPEQLRKLFIGGLSFETTDESLRSHFEQWGTLTDCVDS<br>QRPGAHLTVKKIFVGGIKEDTEEHHLRDYFEQYGKIEVIEIMTDRG<br>SGKKRGFAFVTFDDHDSVDKIVIQKYHTVNGHNCEVRKALSKQE<br>MASASSSQR |
| Polycystic kidney disease protein<br>1-like 1<br>Variant 2<br>SEQ ID NO: 67 | XSRLRASMWIDRSTRAVSVHFTLYNPPTQLFTSVSLRVEILPTGSLV<br>PSSLVESFSIFRSDSALQYHLMLPQLVFLALSLIHLCVQLYRMMDK<br>GVLSYWRKPRNWLELSVVGVSLTYYAVSGHLVTLAGDVTNQFHR<br>GLCRAFMDLTLMASWNQRARWLRGILLFLFTLKCVYLPGIQNTM<br>ASCSSMMRHSLPSIFVAGLVGALMLAALSHLHRFLLSMWVLPPGT<br>FTDAFPGLLFHFPRRSQKDCLLGLSKSDQRAMACYFGILLIVSATL<br>CFGMLRGFLMTLPQKRKSFQSKSFVRLKDVTAYMWEKVLTFLRL<br>ETPKLEEAEMVENHNYYLDEFANLLDELLMKINGLSDSLQLPLLE<br>KTSNNTGEARTEESPLVDISSYQAAESLTLVTQTEVQWHDLGSLQP<br>PHPRFKQFSCLSLPSSWDYRRVPLCLANF |
| Polycystic kidney disease protein<br>1-like 1<br>Variant 3<br>SEQ ID NO: 68 | XVGGPENPYLIDPENQNVTLNGPGGCGTREDCVLSLGRTRTEAHT<br>ALSRLRASMWIDRSTRAVSVHFTLYNPPTQLFTSVSLRVEILPTGSL<br>VPSSLVESFSIFRSDSALQYHLMLPQLVFLALSLIHLCVQLYRMMD<br>KGVLSYWRKPRNWLEVASLVSFSFEK |
| Heat shock protein cognate 71 kDa<br>Variant 2<br>SEQ ID NO: 69 | MSKGPAVGIDLGTTYSCVGVFQHGKVEIIANDQGNRTTPSYVAFT<br>DTERLIGDAAKNQVAMNPTNTVFDAKRLIGRRFDDAVVQSDMKH<br>WPFMVVNDAGRPKVQVEYKGETKSFYPEEVSSMVLTKMKEIAEA<br>YLGKTVTNAVVTVPAYFNDSQRQATKDAGTIAGLNVLRIINEPTA<br>AAIAYGLDKKVGAERNVLIFDLGGGTFDVSILTIEDGIFEVKSTAGD<br>THLGGEDFDNRMVNHFIAEFKRKHKKDISENKRAVRRLRTACERA |

TABLE 1-continued

| Protein name/SEQ ID NO. | Amino acid sequence |
| --- | --- |
| | KRTLSSSTQASIEIDSLYEGIDFYTSITRARFEELNADLFRGTLDPVE
KALRDAKLDKSQIHDIVLVGGSTRIPKIQKLLQDFFNGKELNKSINP
DEAVAYGAAVQAAILSGDKSENVQDLLLLDVTPLSLGIETAGGVM
TVLIKRNTTIPTKQTQTFTTYSDNQPGVLIQVYEGERAMTKDNNLL
GKFELTGIPPAPRGVPQIEVTFDIDANGILNVSAVDKSTGKENKITIT
NDKGRLSKEDIERMVQEAEKYKAEDEKQRDKVSSKNSLESYAFN
MKATVEDEKLQGKINDEDKQKILDKCNEIINWLDKNQTAEKEEFE
HQQKELEKVCNPIITKLYQSAGGMPGGMPGGFPGGGAPPSGGASS
GPTIEEVD |
| Heat shock protein cognate 71 kDa Variant 3 SEQ ID NO: 70 | MSKGPAVGIDLGTTYSCVGVFQHGKVEIIANDQGNRTTPSYVAFT
DTERLIGDAAKNQVAMNPTNTVFDAKRLIGRRFDDAVVQSDMKH
WPFMVVNDAGRPKVQVEYKGETKSFYPEEVSSMVLTKMKEIAEA
YLGKTVTNAVVTVPAYFNDSQRQATKDAGTIAGLNVLRIINEPTA
AAIAYGLDKKVGAERNVLIFDLGGGTFDVSILTIEDGIFEVKSTAGD
THLGGEDFDNRMVNHFIAEFKRKHKKDISENKRAVRRLRTACERA
KRTLSSSTQASIEIDSLYEGIDFYTSITRARFEELNADLFRGTLDPVE
KALRDAKLDKSQIHDIVLVGGSTRIPKIQKLLQDFFNGKELNKSINP
DEAVAYGAAVQAAILSGDKSENVQDLLLLDVTPLSLGIETAGGVM
TVLIKRNTTIPTKQTQTFTTYSDNQPGVLIQVYEGERAMTKDNNLL
GKFELTGIPPAPRGVPQIEVTFDIDANGILNVSAVDKSTGKENKITIT
NDKGRLSKEDIERMVQEAEKYKAEDEKQRDKVSSKNSLESYAFN
MKATVEDEKLQGKINDEDKQKILDKCNEIINWLDKNQTAEKEEFE
HQQKELEKVCNPIITKLYQSAGGMPGGMPGGFPGGGAPPSGGASS
GPTIEEVD |
| Heat shock protein cognate 71 kDa Variant 4 SEQ ID NO: 71 | MSKGPAVGIDLGTTYSCVGVFQHGKVEIIANDQGNRTTPSYVAFT
DTERLIGDAAKNQVAMNPTNTVFDAKRLIGRRFDDAVVQSDMKH
WPFMVVNDAGRPKVQVEYKGETKSFYPEEVSSMVLTKMKEIAEA
YLGKTVTNAVVTVPAYFNDSQRQATKDAGTIAGLNVLRIINEPTA
AAIAYGLDKKVGAERNVLIFDLGGGTFDVSILTIEDGIFEVKSTAGD
THLGGEDFDNRMVNHFIAEFKRKHKKDISENKRAVRRLRTACERA
KRTLSSSTQASIEIDSLYEGIDFYTSITRARFEELNADLFRGTLDPVE
KALRDAKLDKSQIHDIVLVGGSTRIPKIQKLLQDFFNGKELNKSINP
DEAVAYGAAVQAAILSGDKSENVQDLLLLDVTPLSLGIETAGGVM
TVLIKRNTTIPTKQTQTFTTYSDNQPGVLIQVYEGERAMTKDNNLL
GKFELTGMPGGMPGGFPGGGAPPSGGASSGPTIEEVD |
| Heat shock protein cognate 71 kDa Variant 5 SEQ ID NO: 72 | MSKGPAVGIDLGTTYSCVGVFQHGKVEIIANDQGNRTTPSYVAFT
DTERLIGDAAKNQVAMNPTNTVFDAKRLIGRRFDDAVVQSDMKH
WPFMVVNDAGRPKVQVEYKGETKSFYPEEVSSMVLTKMKEIAEA
YLGKATKDAGTIAGLNVLRIINEPTAAAIAYGLDKKVGAERNVLIF
DLGGGTFDVSILTIEDGIFEVKSTAGDTHLGGEDFDNRMVNHFIAE
FKRKHKKDISENKRAVRRLRTACERAKRTLSSSTQASIEIDSLYEGI
DFYTSITRARFEELNADLFRGTLDPVEKALRDAKLDKSQIHDIVLV
GGSTRIPKIQKLLQDFFNGKELNKSINPDEAVAYGAAVQAAILSGD
KSENVQDLLLLDVTPLSLGIETAGGVMTVLIKRNTTIPTKQTQTFTT
YSDNQPGVLIQVYEGERAMTKDNNLLGKFELTGIPPAPRGVPQIEV
TFDIDANGILNVSAVDKSTGKENKITITNDKGRLSKEDIERMVQEA
EKYKAEDEKQRDKVSSKNSLESYAFNMKATVEDEKLQGKINDED
KQKILDKCNEIINWLDKNQTAEKEEFEHQQKELEKVCNPIITKLYQ
SAGGMPGGMPGGFPGGGAPPSGGASSGPTIEEVD |
| Heat shock protein cognate 71 kDa Variant 6 SEQ ID NO: 73 | MVNHFIAEFKRKHKKDISENKRAVRRLRTACERAKRTLSSSTQASI
EIDSLYEGIDFYTSITRARFEELNADLFRGTLDPVEKALRDAKLDKS
QIHDIVLVGGSTRIPKIQKLLQDFFNGKELNKSINPDEAVAYGAAV
QAAILSGDKSENVQDLLLLDVTPLSLGIETAGGVMTVLIKRNTTIPT
KQTQTFTTYSDNQPGVLIQVYEGERAMTKDNNLLGKFELTGIPPAP
RGVPQIEVTFDIDANGILNVSAVDKSTGKENKITITNDKGRLSKEDI
ERMVQEAEKYKAEDEKQRDKVSSKNSLESYAFNMKATVEDEKLQ
GKINDEDKQKILDKCNEIINWLDKNQTAEKEEFEHQQKELEKVCN
PIITKLYQSAGGMPGGMPGGFPGGGAPPSGGASSGPTIEEVD |
| Heat shock protein cognate 71 kDa Variant 7 SEQ ID NO: 74 | MSKGPAVGIDLGTTYSCVGVFQHGKVEIIANDQGNRTTPSYVAFT
DTERLIGDAAKNQVAMNPTNTVFDAKRLIGRRFDDAVVQSDMKH
WPFMVVNDAGRPKHKKDISENKRAVRRLRTACERAKRTLSSSTQ
ASIEIDSLYEGIDFYTSITRARFEELNADLFRGTLDPVEKALRDAKL
DKSQIHDIVLVGGSTRIPKIQKLLQDFFNGKELNKSINPDEAVAYGA
AVQAAILSGDKSENVQDLLLLDVTPLSLGIETAGGVMTVLIKRNTT
IPTKQTQTFTTYSDNQPGVLIQVYEGERAMTKDNNLLGKFELTGIP
PAPRGVPQIEVTFDIDANGILNVSAVDKSTGKENKITITNDKGRLSK
EDIERMVQEAEKYKAEDEKQRDKVSSKNSLESYAFNMKATVEDE
KLQGKINDEDKQKILDKCNEIINWLDKNQTAEKEEFEHQQKELEK
VCNPIITKLYQSAGGMPGGMPGGFPGGGAPPSGGASSGPTIEEVD |
| Heat shock protein cognate 71 kDa Variant 8 SEQ ID NO: 75 | MNPTNTVFDAKRLIGRRFDDAVVQSDMKHWPFMVVNDAGRPKV
QVEYKGETKSFYPEEVSSMVLTKMKEIAEAYLGKTVTNAVVTVPA
YFNDSQRQATKDAGTIAGLNVLRIINEPTAAAIAYGLDKKVGAER |

TABLE 1-continued

| Protein name/SEQ ID NO. | Amino acid sequence |
|---|---|
| | NVLIFDLGGGTFDVSILTIEDGIFEVKSTAGDTHLGGEDFDNRMVN<br>HFIAEFKRKHKKDISENKRAVRRLRTACERAKRTLSSSTQASIEIDS<br>LYEGIDFYTSITRARFEELNADLFRGTLDPVEKALRDAKLDKSQIH<br>DIVLVGGSTRIPKIQKLLQDFFNGKELNKSINPDEAVAYG |
| Heat shock protein cognate 71 kDa<br>Variant 9<br>SEQ ID NO: 76 | MSKGPAVGIDLGTTYSCVGVFQHGKVEIIANDQGNRTTPSYVAFT<br>DTERLIGDAAKNQVAMNPTNTVFDAKRLIGRRFDDAVVQSDMKH<br>WPFMVVNDAGRPKVQVEYKGETKSFYPEEVSSMVLTKMKEIAEA<br>YLGKTVTNAVVTVPAYFNDSQRQATKDAGTIAGLNVLRIINEPTA<br>AAIAYGLDK |
| Heat shock protein cognate 71 kDa<br>Variant 10<br>SEQ ID NO: 77 | MTVLIKRNTTIPTKQTQTFTTYSDNQPGVLIQVYEGERAMTKDNNL<br>LGKFELTGIPPAPRGVPQIEVTFDIDANGILNVSAVDKSTGKENKITI<br>TNDKGRLSKEDIERMVQEAEKYKAEDEKQRDKVSSKNSLESYAFN<br>MKATVEDEKLQGKINDEDKQKILDKCNEIINWLDKNQTAEKEEFE<br>HQQKELEKVCNPIITKLYQSAGGMPGGMPGGFPGGGAPP |
| Heat shock protein cognate 71 kDa<br>Variant 11<br>SEQ ID NO: 78 | MTKDNNLLGKFELTGIPPAPRGVPQIEVTFDIDANGILNVSAVDKST<br>GKENKITITNDKGRLSKEDIERMVQEAEKYKAEDEKQRDKVSSKN<br>SLESYAFNMKATVEDEKLQGKINDEDKQKILDKCNEIINWLDKNQ<br>TAEKEEFEHQQKE |
| Heat shock protein cognate 71 kDa<br>Variant 12<br>SEQ ID NO: 79 | MSKGPAVGIDLGTTYSCVGVFQHGKVEIIANDQGNRTTPSYVAFT<br>DTERLIGDAAKNQVAMNPTNTVFDAKRLIGRRFDDAVVQSDMKH<br>WPFMVVNDAGRPKVQVEYKGETKSFYPEEVSSMVLTKMKEIAEA<br>YLGKTVTNAVVTVPAYFNDSQRQATKDAGTIAGLNVLR |
| Heat shock protein cognate 71 kDa<br>Variant 13<br>SEQ ID NO: 80 | MSKGPAVGIDLGTTYSCVGVFQHGKVEIIANDQGNRTTPSYVAFT<br>DTERLIGDAAKNQVAMNPTNTVFDAKRLIGRRFDDAVVQSDMKH<br>WPFMVVNDAGRPKVQVEYKGETKSFYPEEVSSMVLTKMKEIAE |
| Heat shock protein cognate 71 kDa<br>Variant 14<br>SEQ ID NO: 81 | MSKGPAVGIDLGTTYSCVGVFQHGKVEIIANDQGNRTTPSYVAFT<br>DTERLIGDAAKNQVAMNPTNTVFDAKRLIGRRFDDAVVQSDMKH<br>WPFMVVNDAGRPKVQVEYKGETKSFYPEEVSSMVLTKMKEIAEA<br>YLGKTVTNAVVTVPAYFNDSQRQATKDAGTIAGLNVLRIINEPTA<br>AAIAY |
| Heat shock protein cognate 71 kDa<br>Variant 15<br>SEQ ID NO: 82 | MSKGPAVGIDLGTTYSCVGVFQHGKVEIIANDQGNRTTPSYVAFT<br>DTERLIGDAAKNQVAMNPTNTVFETKSFYPEEVSSMVLTKMKEIA<br>EAYLGKTVTNAVVTVPAYFNDSQRQATKDAGTIAGLNVLRIINEPT<br>AAAIAYGLDKKVGAERNVLIFDLGGGTFDVSI |
| Heat shock protein cognate 71 kDa<br>Variant 16<br>SEQ ID NO: 83 | MSKGPAVGIDLGTTYSCVGVFQHGKVEIIANDQGNRTTPSYVAFT<br>DTERLIGDAAKNQVAMNPTNTVFDAKRLIGRRFDDAVVQSDMKH<br>WPFMVVNDAGRPKVQVEYKGETKSFYPEEVSSMVLTKMKEIAEA<br>YLGKTVTNAVVTVPAYFNDSQRQATKDAGTIAGLNVLRIINEPTA |
| Heat shock protein cognate 71 kDa<br>Variant 17<br>SEQ ID NO: 84 | MSKGPAVGIDLGTTYSCVGVFQHGKVEIIANDQGNRTTPSYVAFT<br>DTERLIGDAAKNQVAMNPTNTVFDAKRLIGRRFDDAVVQSDMKH<br>WPFMVVNDAGRPKVQVEYKGETKSFYPEEVSSMVLTKMKEIAEA<br>YLGK |
| Ankyrin-3<br>Variant 2<br>SEQ ID NO: 85 | MASSASSSPAGTEDSAPAQGGFGSDYSRSSRKSDANASYLRAARA<br>GHLEKALDYIKNGVDINICNQNGLNALHLASKEGHVEVVSELLQR<br>EANVDAATKKGNTALHIASLAGQAEVVKVLVTNGANVNAQSQN<br>GFTPLYMAAQENHLEVVKFLLDNGASQSLATEDGFTPLAVALQQG<br>HDQVVSLLLENDTKGKVRLPALHIAARKDDTKAAALLLQNDNNA<br>DVESKSGFTPLHIAAHYGNINVATLLLNRAAAVDFTARNDITPLHV<br>ASKRGNANMVKLLLDRGAKIDAKTRDGLTPLHCGARSGHEQVVE<br>MLLDRAAPILSKTKNGLSPLHMATQGDHLNCVQLLLQHNVPVDD<br>VTNDYLTALHVAAHCGHYKVAKVLLDKKANPNAKALNGFTPLHI<br>ACKKNRIKVMELLLKHGASIQAVTESGLTPIHVAAFMGHVNIVSQL<br>MHHGASPNTTNVRGETALHMAARSGQAEVVRYLVQDGAQVEAK<br>AKDDQTPLHISARLGKADIVQQLLQQGASPNAATTSGYTPLHLSAR<br>EGHEDVAAFLLDHGASLSITTKKGFTPLHVAAKYGKLEVANLLLQ<br>KSASPDAAGKSGLTPLHVAAHYDNQKVALLLLDQGASPHAAAKN<br>GYTPLHIAAKKNQMDIATTLLEYGADANAVTRQGIASVHLAAQEG<br>HVDMVSLLLGRNANVNLSNKSGLTPLHLAAQEDRVNVAEVLVNQ<br>GAHVDAQTKMGYTPLHVGCHYGNIKIVNFLLQHSAKVNAKTKNG<br>YTPLHQAAQQGHTHIINVLLQNNASPNELTVNGNTALGIARRLGYI<br>SVVDTLKIVTEETMTTTTVTEKHKMNVPETMNEVLDMSDDEVRK<br>ANAPAPEMLSDGEYISDVEEGEDAMTGTDKYLGPQDLKELGDDSLP<br>AEGYMGFSLGARSASLRSFSSDRSYTLNRSSYARDSMMIEEELLVPS<br>KEQHLTFTREFDSDSLRHYSWAADTLDNVNLVSSPIHSGFLVSFMV<br>DARGGSMRGSRHHGMRIIIPPRKCTAPTRITCRLVKRHKLANPPPM<br>VEGEGLASRLVEMGPAGAQFLGPVIVEIPHFGSMRGKERELIVLRS<br>ENGETWKEHQFDSKNEDLTELLNGMDEELDSPEELGKKRICRIITK<br>DFPQYFAVVSRIKQESNQIGPEGGILSSTTVPLVQASFPEGALTKRIR |

TABLE 1-continued

| Protein name/SEQ ID NO. | Amino acid sequence |
| --- | --- |
| | VGLQAQPVPDEIVKKILGNKATFSPIVTVEPRRRKFHKPITMTIPVPP<br>PSGEGVSNGYKGDTTPNLRLLCSITGGTSPAQWEDITGTTPLTFIKD<br>CVSFTTNVSARFWLADCHQVLETVGLATQLYRELICVPYMAKFVV<br>FAKMNDPVESSLRCFCMTDDKVDKTLEQQENFEEVARSKDIEVLE<br>GKPIYVDCYGNLAPLTKGGQQLVFNFYSFKENRLPFSIKIRDTSQEP<br>CGRLSFLKEPKTTKGLPQTAVCNLNITLPAHKKIEKTDRRQSFASL<br>ALRKRYSYLIEPGMSPQSPCERTDIRMAIVADHLGLSWTELARELN<br>FSVDEINQIRVENPNSLISQSFMLLKKWVTRDGKNATTDALTSVLT<br>KINRIDIVTLLEGPIFDYGNISGTRSFADENNVFHDPVDGYPSLQVE<br>LETPTGLHYTPPTPFQQDDYFSDISSIESPLRTPSRLSDGLVPSQGNIE<br>HSADGPPVVTAEDASLEDSKLEDSVPLTEMPEAVDVDESQLENVC<br>LSWQNETSSGNLESCAQARRVTGGLLDRLDDSPDQCRDSITSYLK<br>GEAGKFEANGSHIEITPEAKTKSYFPESQNDVGKQSTKETLKPKIH<br>GSGHVEEPASPLAAYQKSLEETSKLIIEETKPCVPVSMKKMSRTSPA<br>DGKPRLSLHEEEGSSGSEQKQGEGFKVKTKKEIRHVEKKSHS |
| Ankyrin-3<br>Variant 3<br>SEQ ID NO: 86 | MSEEPKEKNAKPAHRKRKGKKSDANASYLRAARAGHLEKALDYI<br>KNGVDINICNQNGLNALHLASKEGHVEVVSELLQREANVDAATK<br>KGNTALHIASLAGQAEVVKVLVTNGANVNAQSQNGFTPLYMAAQ<br>ENHLEVVKFLLDNGASQSLATEDGFTPLAVALQQGHDQVVSLLLE<br>NDTKGKVRLPALHIAARKDDTKAAALLLQNDNNADVESKSGFTPL<br>HIAAHYGNINVATLLLNRAAAVDFTARNDITPLHVASKRGNANMV<br>KLLLLDRGAKIDAKTRDGLTPLHCGARSGHEQVVEMLLDRAAPILS<br>KTKNGLSPLHMATQGDHLNCVQLLLQHNVPVDDVTNDYLTALHV<br>AAHCGHYKVAKVLLDKKANPNAKALNGFTPLHIACKKNRIKVME<br>LLLKHGASIQAVTESGLTPIHVAAFMGHVNIVSQLMHHGASPNTT<br>NVRGETALHMAARSGQAEVVRYLVQDGAQVEAKAKDDQTPLHIS<br>ARLGKADIVQQLLQQGASPNAATTSGYTPLHLSAREGHEDVAAFL<br>LDHGASLSITTKKGFTPLHVAAKYGKLEVANLLLQKSASPDAAGK<br>SGLTPLHVAAHYDNQKVALLLLDQGASPHAAAKNGYTPLHIAAK<br>KNQMDIATTLLEYGADANAVTRQGIASVHLAAQEGHVDMVSLLL<br>GRNANVNLSNKSGLTPLHLAAQEDRVNVAEVLVNQGAHVDAQT<br>KMGYTPLHVGCHYGNIKIVNFLLQHSAKVNAKTKNGYTPLHQAA<br>QQGHTHIINVLLQNNASPNELTVNGNTALGIARRLGYISVVDTLKI<br>VTEETMTTTTVTEKHKMNVPETMNEVLDMSDDEVRKANAPEMLS<br>DGEYISDVEEGNRCTWYKIPKVQEFTVKSEDAMTGDTDKYLGPQD<br>LKELGDDSLPAEGYMGFSLGARSASLRSFSSDRSYTLNRSSYARDS<br>MMIEELLVPSKEQHLTFTREFDSDSLRHYSWAADTLDNVNLVSSPI<br>HSGFLVSFMVDARGGSMRGSRHHGMRIIIPPRKCTAPTRITCRLVK<br>RHKLANPPPMVEGEGLASRLVEMGPAGAQFLGPVIVEIPHFGSMR<br>GKERELIVLRSENGETWKEHQFDSKNEDLTELLNGMDEELDSPEEL<br>GKKRICRIITKDFPQYFAVVSRIKQESNQIGPEGGILSSTTVPLVQAS<br>FPEGALTKRIRVGLQAQPVPDEIVKKILGNKATFSPIVTVEPRRRKF<br>HKPITMTIPVPPPSGEGVSNGYKGDTTPNLRLLCSITGGTSPAQWED<br>ITGTTPLTFIKDCVSFTTNVSARFWLADCHQVLETVGLATQLYRELI<br>CVPYMAKFVVFAKMNDPVESSLRCFCMTDDKVDKTLEQQENFEE<br>VARSKDIEVLEGKPIYVDCYGNLAPLTKGGQQLVFNFYSFKENRLP<br>FSIKIRDTSQEPCGRLSFLKEPKTTKGLPQTAVCNLNITLPAHKKIEK<br>TDRRQSFASLALRKRYSYLTEPGMSPQSPCERTDIRMAIVADHLGL<br>SWIELARELNFSVDEINQIRVENPNSLISQSFMLLKKWVTRDGKNA<br>TTDALTSVLTKINRIDIVTLLEGPIFDYGNISGTRSFADENNVFHDPV<br>DGYPSLQVELETPTGLHYTPPTPFQQDDYFSDISSIESPLRTPSRLSD<br>GLVPSQGNIEHSADGPPVVTAEDASLEDSKLEDSVPLTEMPEAVDV<br>DESQLENVCLSWQNETSSGNLESCAQARRVTGGLLDRLDDSPDQC<br>RDSITSYLKGEAGKFEANGSHTEITPEAKTKSYFPESQNDVGKQST<br>KETLKPKIHGSGHVEEPASPLAAYQKSLEETSKLIIEETKPCVPVSM<br>KKMSRTSPADGKPRLSLHEEEGSSGSEQKQGEGFKVKTKKEIRHV<br>EKKSHS |
| Ankyrin-3<br>Variant 4<br>SEQ ID NO: 87 | MALPQSEDAMTGDTDKYLGPQDLKELGDDSLPAEGYMGFSLGAR<br>SASLRSFSSDRSYTLNRSSYARDSMMEEELLVPSKEQHLTFTREFDS<br>DSLRHYSWAADTLDNVNLVSSPIHSGFLVSFMVDARGGSMRGSR<br>HHGMRIIIPPRKCTAPTRITCRLVKRHKLANPPPMVEGEGLASRLVE<br>MGPAGAQFLGPVIVEIPHFGSMRGKERELIVLRSENGETWKEHQFD<br>SKNEDLTELLNGMDEELDSPEELGKKRICRIITKDFPQYFAVVSRIK<br>QESNQIGPEGGILSSTTVPLVQASFPEGALTKRIRVGLQAQPVPDEI<br>VKKILGNKATFSPIVTVEPRRRKFHKPITMTIPVPPPSGEGVSNGYK<br>GDTTPNLRLLCSITGGTSPAQWEDITGTTPLTFIKDCVSFTTNVSAR<br>FWLADCHQVLETVGLATQLYRELICVPYMAKFVVFAKMNDPVES<br>SLRCFCMTDDKVDKTLEQQENFEEVARSKDIEVLEGKPIYVDCYG<br>NLAPLTKGGQQLVFNFYSFKENRLPFSIKIRDTSQEPCGRLSFLKEP<br>KTTKGLPQTAVCNLNITLPAHKKIEKTDRRQSFASLALRKRYSYLT<br>EPGMSPQSPCERTDIRMAIVADHLGLSWIELARELNFSVDEINQIR<br>VENPNSLISQSFMLLKKWVTRDGKNATTDALTSVLTKINRIDIVTL<br>LEGPIFDYGNISGTRSFADENNVFHDPVDGYPSLQVELETPTGLHY<br>TPPTPFQQDDYFSDISSIESPLRTPSRLSDGLVPSQGNIEHSADGPPV<br>VTAEDASLEDSKLEDSVPLTEMPEAVDVDESQLENVCLSWQNETS<br>SGNLESCAQARRVTGGLLDRLDDSPDQCRDSITSYLKGEAGKFEA |

TABLE 1-continued

| Protein name/SEQ ID NO. | Amino acid sequence |
| --- | --- |
| | NGSHTEITPEAKTKSYFPESQNDVGKQSTKETLKPKIHGSGHVEEP ASPLAAYQKSLEETSKLIIEETKPCVPVSMKKMSRTSPADGKPRLSL HEEEGSSGSEQKQGEGFKVKTKKEIRHVEKKSHS |
| Ankyrin-3 Variant 5 SEQ ID NO: 88 | XFLVSFMVDARGGSMRGSRHHGMRIIIPPRKCTAPTRITCRLVKRH KLANPPPMVEGEGLASRLVEMGPAGAQFLGPVIVEIPHFGSMRGK ERELIVLRSENGETWKEHQFDSKNEDLTELLNGMDEELDSPEELGK KRICRIITKDFPQYFAVVSRIKQESNQIGPEGGILSSTTVPLVQASFPE GALTKRIRVGLQAQPVPDEIVKKILGNKATFSPIVTVEPRRRKFHKP ITMTIPVPPPSGEGVSNGYKGDTTPNLRLLCSITGGTSPAQWEDITG TTPLTFIKDCVSFTTNVSARFWLADCHQVLETVGLATQLYRELICV PYMAKFVVFAKMNDPVESSLRCFCMTDDKVDKTLEQQENFEEVA RSKDIEVLEGKPIYVDCYGNLAPLTKGGQQLVFNFYSFKENRLPFSI KIRDTSQEPCGRLSFLKEPKTTKGLPQTAVCNLNITLPAHKKIEKTD RRQSFASLALRKRYSYLTEPGMKTVERSTGATRSLPTTYSYKPFFS TRPYQSWTTAPITVPGPAKSGFTSLSSSSSNTPSASPLKSIWSVSTPS PIKSTLGASTTSSVKSISDVASPIRSFRTMSSPIKTVVSQSPYNIQVSS GTLARAPAVTEATPLKGLASNSTFSSRTSPVTTAGSLLERSSITMTP PASPKSNINMYSSSLPFKSIITSAAPLISSSPLKSVVSPVKSAVDVISSA KITMASSLSSPVKQMPGHAEVALVNGSISPLKYPSSSTLINGCKATA TLQEKISSATNSVSSVVSAATDTVEKVFSTTTAMPFSPLRSYVSAAP SAFQSLRTPSASALYTSLGSSISATTSSVTSSIITVPVYSVVNVLPEPA LKKLPDSNSFTKSAAALLSPIKTLTTETHPQPHFSRTSSPVKSSLFLA PSALKLSTPSSLSSSQEILKDVAEMKEDLMRMTAILQTDVPEEKPFQ PELPKEGRIDDEEPFKIVEKVKEDLVKVSEILKKDVCVDNKGSPKSP KSDKGHSPEDDWIEFSSEEIREARQQAAASQSPSLPERVQVKAKAA SEKDYNLTKVIDYLTNDIGSSSLTNLKYKFEDAKKDGEERQKRVL KPAIALQEHKLKMPPASMRTSTSEKELCKMADSFFGTDTILESPDD FSQHDQDKSPLSDSGFETRSEKTPSAPQSAESTGPKPLFHEVPIPPVI TETRIEVVHVIRSYDPSAGDVPQTQPEEPVSPKPSPTFMELEPKPTT SSIKEKVKAFQMKASSEEDDHNRVLSKGMRVKEETHITTTTRMVY HSPPGEGASERIEETMSVHDIMKAFQSGRDPSKELAGLFEHKSAV SPDVHKSAAETSAQHAEKDNQMKPKLERIIEVHIEKGPQSPCERTDI RMAIVADHLGLSWTELARELNFSVDEINQIRVENPNSLISQSFMLL KKWVTRDGKNATTDALTSVLTKINRIDIVTLLEGPIFDYGNISGTRS FADENNVFHDPVDGWQNETSSGNLESCAQARRVTGGLLDRLDDS PDQCRDSITSYLKGEAGKFEANGSHTEITPEAKTKSYFPESQNDVG KQSTKETLKPKIHGSGHVEEPASPLAAYQKSLEETSKLIIEETKPCV PVSMKKMSRTSPADGKPRLSLHEEEGSSGSEQKQGEGFKVKTKKE IRHVEKKSHS |
| Ankyrin-3 Variant 6 SEQ ID NO: 89 | XPVIVEIPHFGSMRGKERELIVLRSENGETWKEHQFDSKNEDLILL LNGMDEELDSPEELGKKRICRIITKDFPQYFAVVSRIKQESNQIGPE GGILSSTTVPLVQASFPEGALTKRIRVGLQAQPVPDEIVKKILGNKA TFSPIVTVEPRRRKFHKPITMTIPVPPPSGEGVSNGYKGDTTPNLRL LCSITGGTSPAQWEDITGTTPLTFIKDCVSFTTNVSARFWLADCHQ VLETVGLATQLYRELICVPYMAKFVVFAKMNDPVESSLRCFCMTD DKVDKTLEQQENFEEVARSKDIEVLEGKPIYVDCYGNLAPLTKGG QQLVFNFYSFKENRLPFSIKIRDTSQEPCGRLSFLKEPKTTKGLPQT AVCNLNITLPAHKKETESDQDDEIEKTDRRQSFASLALRPQSPCERT DIRMAIVADHLGLSWTELARELNFSVDEINQIRVENPNSLISQSFML LKKWVTRDGKNATTDALTSVLTKINRIDIVTLLEGPIFDYGNISGTR SFADENNVFHDPVDGYPSLQVELETPTGLHYTPPTPFQQDDYFSDI SSIESPLRTPSRLSDGLVPSQGNIEHSADGPPVVTAEDASLEDSKLE DSVPLTEMPEAVDVDESQLENVCLSEYPQYLGNLAGSPKDVKPAE PRKLGVSSEQQEKGKSGPDEEMMEEKLKSLFEDIQLEEGVESEEMT EEKVQAILKRVQQAELEMSSITGWQNETSSGNLESCAQARRVTGG LLDRLDDSPDQCRDSITSYLKGEAGKFEANGSHTETTPEAKTKSYFP ESQNDVGKQSTKETLKPKIHGSGHVEEPASPLAAYQKSLEETSKLII EETKPCVPVSMKKMSRTSPADGKPRLSLHEEEGSSGSEQKDLKDS ESDSSSEEERRVTTRVIRRRLIIKGEEEAKNIPGESVTEEQFTDEEGNLI TRKITRKVLRRIVIPQERKRDDVQGEGFKVKTKKEIRHVEKKSHS |
| Ankyrin-3 Variant 7 SEQ ID NO: 90 | PKTTKGLPQTAVCNLNITLPAHKKETESDQDDEIEKTDRRQSFASL ALRKRYSYLTEPGMSPQSPCERTDIRMAIVADHLGLSWTELARELN FSVDEINQIRVENPNSLISQSFMLLKKWVTRDGKNATTDALTSVLT KINRIDIVTLLEGPIFDYGNISGTRSFADENNVFHDPVDGYPSLQVE LETPTGLHYTPPTPFQQDDYFSDISSIESPLRTPSRLSDGLVPSQGNIE HSADGPPVVTAEDASLEDSKLEDSVPLTEMPEAVDVDESQLENVC LSWQNETSSGNLESCAQARRVTGGLLDRLDDSPDQCRDSITSYLK GEAGKFEANGSHTEITPEAKTKSYFPESQNDVGKQSTKETLKPKIH GSGHVEEPASPLAAYQKSLEETSKLIIEETKPCVPVSMKKMSRTSPA DGKPRLSLHEEEGSSGSEQKQGEGFKVKTKKEIRHVEKKSHS |
| Ankyrin-3 Variant 8 SEQ ID NO: 91 | XLARELNFSVDEINQIRVENPNSLISQSFMLLKKWVTRDGKNATTD ALTSVLTKINRIDIVTLLEGPIFDYGNISGTRSFADENNVFHDPVDG NRI |

TABLE 1-continued

| Protein name/SEQ ID NO. | Amino acid sequence |
| --- | --- |
| Ankyrin-3 Variant 9 SEQ ID NO: 92 | XGPDEDKPPSKSSSSEKTPDKTDQKSGAQFFTLEGRHPDRSVFPDT YFSYKVDEEFATPFKTVATKGLDFDPWSNNRGDDEVFDSKSREDE TKPFGLAVEDRSPATTPDTTPARTPTDESTPTSEPNPFPFHEGKMFE MTRSGAIDMSKRDFVEERLQFFQIGPQSPCERTDIRMAIVADHLGL SWTELARELNFSVDEINQIRVENPNSLISQSFMLLKKWVTRDGKNA TTDALTSVLTKINRIDIVTLLEGPIFDYGNISGTRSFADENNVFHDPV DGWQNETSSGNLESCAQARRVTGGLLDRLDDSPDQCRDSITSYL |
| Ankyrin-3 Variant 10 SEQ ID NO: 93 | MAVEEGESFPEQSDANASYLRAARAGHLEKALDYIKNGVDINICN QNGLNALHLASKEGHVEVVSELLQREANVDAATKKGNTALHIAS LAGQAEVVKVLVTNGANVNAQSQNGFTPLYMAAQENHLEVVKF LLDNGASQSLATEDGFTPLAVALQQGHDQVVSLLLENDTKGKVRL PALHIAARKDDTKAAALLLQNDNNADVESKSGFTPLHIAAHYGNI NVATLLLNRAAAVDFTARNDITPLHVASKRGNANMVKLLLDRGA KIDAKTR |
| Ankyrin-3 Variant 11 SEQ ID NO: 94 | MAVEEGESFPEQSDANASYLRAARAGHLEKALDYIKNGVDINICN QNGLNALHLASKEGHVEVVSELLQREANVDAATKKGNTALHIAS LAGQAEVVKVLVTNGANVNAQSQNGFTPLYMAAQENHLEVVKF LLDNGASQSLATEDGFTPLAVALQQGHDQVVSLLLENDTKGKVRL PALHIAARKDDTKAAALLLQNDNNADVESKSGFTPLHIAAHYGNI NVATLLLNRAAAVDFTARNDITPLHVASKRGNANMVKLLLDRGA KIDAKTR |
| Ankyrin-3 Variant 12 SEQ ID NO: 95 | XTVATKGLDFDPWSNNRGDDEVFDSKSREDETKPFGLAVEDRSPA TTPDTTPARTPTDESTPTSEPNPFPFHEGKMFEMTRSGAIDMSKRDF VEERLQFFQIGPQSPCERTDIRMAIVADHLGLSWTELARELNFSVD EINQIRVENPNSLISQSFMLLKKWVTRDGKNATTDALTSVLTKINRI DIVTLLEGPIFDYGNISGTRSFADENNVFHDPVDGYPSLQVELETPT GLHYTPPTP |
| Ankyrin-3 Variant 13 SEQ ID NO: 96 | XWQNETSSGNLESCAQARRVTGGLLDRLDDSPDQCRDSITSYLKG EAGKFEANGSHTEITPEAKTKSYFPESQNDVGKQSTKETLKPKIHG SGHVEEPASPLAAYQKSLEETSKLIIEETKPCVPVSMKKMSRTSPAD GKPRLSLHEEEGSSGSEQKGEGFKVKTKKEIRHVEKKSHS |
| Ankyrin-3 Variant 14 SEQ ID NO: 97 | MNVPETMNEVLDMSDDEGNRCTWYKIPKVQEFTVKSEDAMTGD TDKYLGPQDLKELGDDSLPAEGYMGFSLGARSARYFVVAVFHS |
| Ankyrin-3 Variant 15 SEQ ID NO: 98 | MTGDTDKYLGPQDLKELGDDSLPAEGYMGFSLGARSASLRSFSSD RSYTLNRSSYARDSMMIEELLVPSKEQHLTFTREFDSDSLRHYSWA ADTLDNVNLVSSPIHSGFLVSFMVDARGGSMRGSRHHGMRIIIPPR KCTAPTRITCRLVKRHKLANPPPMVEGEGLASRLVEMGPAGAQFL GPVIVEIPHFGSM |
| Ankyrin-3 Variant 16 SEQ ID NO: 99 | SPDQCRDSITSYLKGEAGKFEANGSHTEITPEAKTKSYFPESQNDV GKQSTKETLKPKIHGSGHVEEPASPLAAYQKSLEETSKLIIEETKPC VPVSMKKMSRTSPADGKPRLSLHEEEGSSGSEQKVKSPGAAPTRM TACCYKQGEGFKVKTKKEIRHVEKKSHS |
| Ankyrin-3 Variant 17 SEQ ID NO: 100 | XLARELNFSVDEINQIRVENPNSLISQSFMLLKKWVTRDGKNATTD ALTSVLTKINRIDIVTLLEGPIFDYGNISGTRSFADENNVFHDPVDVS PNVLSSIGYPSLQVELETPTGLHYTPPTPFQQDDYFSDISSIESPLRTP SRLSDGLVPSQGNIEHSADGPPVVTAEDASLEDSKLEDSVPLTEMP EAVDVDESQLENVCLSWQNETSSGNLES |
| Ankyrin-3 Variant 18 SEQ ID NO: 101 | XEDAMTGDTDKYLGPQDLKELGDDSLPAEGYMGFSLGARSASPKI SLRSFSSDRSYTLNRSSYARDSMMIEELLVPSKEQHLTFTREFDSDS LRHYSWAADTLDNVNLVSSPIHSGYSSPLPQYDSRFLVSFMVDAR GGSMRGSRHHGMRIIIPPRKCTAPTRITCRLVKRHKLANPPPMVEG EGLASRLVEMGPAGAQFL |
| Ankyrin-3 Variant 19 SEQ ID NO: 102 | XSSPIHSGFLVSFMVDARGGSMRGSRHHGMRIIIPPRKCTAPTRITC RLVKRHKLANPPPMVEGEGLASRLVEMGPAGAQFLGKLHLPTNPP PVNEGESLVSRILQLGPQGTKFIGPVIVEIPHFGSMRGKERELIVLRS ENGETWKEHQFDSKNEDLTELLNGMDEELDSPEELGKKRICRIITK DFPQYFAVVS |
| Ankyrin-3 Variant 20 SEQ ID NO: 103 | MTGDTDKYLGPQDLKELGDDSLPAEGYMGFSLGARSASLRSFSSD RSYTLNRSSYARDSMMIEELLVPSKEQ |
| Ankyrin-3 Variant 21 SEQ ID NO: 104 | XIEKTDRRQSFASLALRKRYSYLIEPGMSPQSPCERTDIRMAIVAD HLGLSWTELARELNFSVDEINQIRVENPNSLISQSFMLLKKWVTRD GKNATTDALTSVLTKINRIDIVTLLEGPIFDYGNISGTRSFADENNV FHDPVDDGPPVVTAEDASLEDSKLEDSVPLTEMPEAVDVDESQLE NVC |

TABLE 1-continued

| Protein name/SEQ ID NO. | Amino acid sequence |
|---|---|
| Ankyrin-3 Variant 22 SEQ ID NO: 105 | XSPLAAYQKSLEETSKLIIEETKPCVPVSMKKMSRTSPADGKPRLSL HEEEGSSGSEQKVKSPGAAPTRMTACCYKDLKDSESDSSSEEERR VTTRVIRRRLIIKGEEAKNIPGESVTEEQFTDEEGNLITRKITRKVLR RIVIPQERKRDDVQGEGFKVKTKKEIRHVEKKSHS |
| Ankyrin-3 Variant 23 SEQ ID NO: 106 | MTGDTDKYLGPQDLKELGDDSLPAEGYMGFSLGARSASLRSFSSD RSYTLNRSSYARDSMMIEELLVPSKEQHLTFTREFDSDSLRHYSWA ADTLDNVNLVSSPIHSGFLVSFMVDARGGSMRGSRHHGMRIIIPPR KCTAPTRITCRLVKRHKLANPP |
| Ankyrin-3 Variant 24 SEQ ID NO: 107 | MTGDTDKYLGPQDLKELGDDSLPAEGYMGFSLGARSASHAASTV AKELTDKTGRTNLSHIFQN |
| Rho GTPase-activating protein 32 Variant 2 SEQ ID NO: 108 | MKSRPTKQKLKQRGILKERVFGCDLGEHLLNSGFEVPQVLQSCTA FIERYGIVDGIYRLSGVASNIQRLRHEFDSEHVPDLTKEPYVQDIHS VGSLCKLYFRELPNPLLTYQLYEKFSDAVSAATDEERLIKIHDVIQQ LPPPHYRTLEFLMRHLSLLADYCSITNMHAKNLAIVWAPNLLRSK QIESACFSGTAAFMEVRIQSVVVEFILNHVDVLFSGRISMAMQEGA ASLSRPKSLLVSSPSTKLLTLEEAQARTQAQVNSPIVTENKYIEVGE GPAALQGKFHTIIEFPLERKRPQNKMKKSPVGSWRSFFNLGKSSSV SKRKLQRNESEPSEMKAMALKGGRAEGTLRSAKSEESLTSLHAVD GDSKLFRPRRPRSSSDALSASFNGEMLGNRCNSYDNLPHDNESEEE GGLLHIPALMSPHSAEDVDLSPPDIGVASLDFDPMSFQCSPPKAESE CLESGASFLDSPGYSKDKPSANKKDAETGSSQCQTPGSTASSEPVS PLQEKLSPFFTLDLSPTEDKSSKPSSFTEKVVYAFSPKIGRKLSKSPS MSISEPISVTLPPRVSEVIGTVSNTTAQNASSSTWDKCVEERDATNR SPTQIVKMKTNETVAQEAYESEVQPLDQVAAEEVELPGKEDQSVS SSQSKAVASGQTQTGAVTHDPPQDSVPVSSVSLIPPPPPPKNVARM LALALAESAQQASTQSLKRPGTSQAGYTNYGDIAVATTEDNLSSS YSAVALDKAYFQTDRPAEQFHLQNNAPGNCDHPLPETTATGDPTH SNTTESGEQHHQVDLTGNQPHQAYLSGDPEKARITSVPLDSEKSDD HVSFPEDQSGKNSMPTVSFLDQDQSPPRFYSGDQPPSYLGASVDKL HHPLEFADKSPTPPNLPSDKIYPPSGSPEENTSTATMTYMTTTPATA QMSTKEASWDVAEQPTTADFAAATLQRTHRTNRPLPPPPSQRSAE QPPVVGQVQAATNIGLNNSHKVQGVVPVPERPPEPRAMDDPASAF ISDSGAAAAQCPMATAVQPGLPEKVRDGARVPLLHLRAESVPAHP CGFPAPLPPTRMMESKMIAAIHSSSADATSSSNYHSFVTASSTSVD DALPLPLPVPQPKHASQKTVYSSFARPDVTTEPFGPDNCLHFNMTP NCQYRPQSVPPHHNKLEQHQVYGARSEPPASMGLRYNTYVAPGR NASGHHSKPCSRVEYVSSLSSSVRNTCYPEDIPPYPTIRRVQSLHAP PSSMIRSVPISRTEVPPDDEPAYCPRPLYQYKPYQSSQARSDYHVTQ LQPYFENGRVHYRYSPYSSSSSSYYSPDGALCDVDAYGTVQLRPL HRLPNRDFAFYNPRLQGKSLYSYAGLAPRPRANVTGYFSPNDHNV VSMPPAADVKHTYTSWDLEDMEKYRMQSIRRESRARQKVKGPV MSQYDNMTPAVQDDLGGIYVIHLRSKSDPGKTGLLSVAEGKESRH AAKAISPEGEDRFYRRHPEAEMDRAHHHGGHGSTQPEKPSLPQKQ SSLRSRKLPDMGCSLPEHRAHQEASHRQFCESKNGPPYPQGAGQL DYGSKGIPDTSEPVSYHNSGVKYAASGQESLRLNHKEVRLSKEME RPWVRQPSAPEKHSRDCYKEEEHLTQSIVPPPKPERSHSLKLHHTQ NVERDPSVLYQYQPHGKRQSSVTVVSQYDNLEDYHSLPQHQRGV FGGGGMGTYVPPGFPHPQSRTYATALGQGAFLPAELSLQHPETQIH AE |
| Rho GTPase-activating protein 32 Variant 3 SEQ ID NO: 109 | MKSRPTKQKLKQRGILKERVFGCDLGEHLLNSGFEVPQVLQSCTA FIERYGIVDGIYRLSGVASNIQRLRHEFDSEHVPDLTKEPYVQDIHS VGSLCKLYFRELPNPLLTYQLYEKFSDAVSAATDEERLIKIHDVIQQ LPPPHYRTLEFLMRHLSLLADYCSITNMHAKNLAIVWAPNLLRSK QIESACFSGTAAFMEVRIQSVVVEFILNHVDVLFSGRISMAMQEGA ASLSRPKSLLVSSPSTKLLTLEEAQARTQAQVNSPIVTENKYIEVGE GPAALQGKFHTIIEFPLERKRPQNKMKKSPVGSWRSFFNLGKSSSV SKRKLQRNESEPSEMKAMALKGGRAEGTLRSAKSEESLTSLHAVD GDSKLFRPRRPRSSSDALSASFNGEMLGNRCNSYDNLPHDNESEEE GGLLHIPALMSPHSAEDVDLSPPDIGVASLDFDPMSFQCSPPKAESE CLESGASFLDSPGYSKDKPSANKKDAETGSSQCQTPGSTASSEPVS PLQEKLSPFFTLDLSPTEDKSSKPSSFTEKVVYAFSPKIGRKLSKSPS MSISEPISVTLPPRVSEVIGTVSNTTAQNASSSTWDKCVEERDATNR SPTQIVKMKTNETVAQEAYESEVQPLDQVAAEEVELPGKEDQSVS SSQSKAVASGQTQTGAVTHDPPQDSVPVSSVSLIPPPPPPKNVARM LALALAESAQQASTQSLKRPGTSQAGYTNYGDIAVATTEDNLSSS YSAVALDKAYFQTDRPAEQFHLQNNAPGNCDHPLPETTATGDPTH SNTTESGEQHHQVDLTGNQPHQAYLSGDPEKARITSVPLDSEKSDD HVSFPEDQSGKNSMPTVSFLDQDQSPPRFYSGDQPPSYLGASVDKL HHPLEFADKSPTPPNLPSDKIYPPSGSPEENTSTATMTYMTTTPATA QMSTKEASWDVAEQPTTADFAAATLQRTHRTNRPLPPPPSQRSAE QPPVVGQVQAATNIGLNNSHKVQGVVPVPERPPEPRAMDDPASAF ISDSGAAAAQCPMATAVQPGLPEKVRDGARVPLLHLRAESVPAHP CGFPAPLPPTRMMESKMIAAIHSSSADATSSSNYHSFVTASSTSVD |

TABLE 1-continued

| Protein name/SEQ ID NO. | Amino acid sequence |
|---|---|
| | DALPLPLPVPQPKHASQKTVYSSFARPDVTTEPFGPDNCLHFNMTP
NCQYRPQSVPPHHNKLEQHQVYGARSEPPASMGLRYNTYVAPGR
NASGHHSKPCSRVEYVSSLSSSVRNTCYPEDIPPYPTIRRVQSLHAP
PSSMIRSVPISRTEVPPDDEPAYCPRPLYQYKPYQSSQARSDYHVTQ
LQPYFENGRVHYRSPYSSSSSSYYSPDGALCDVDAYGTVQLRPL
HRLPNRDFAFYNPRLQGKSLYSYAGLAPRPRANVTGYFSPNDHNV
VSMPPAADVKHTYTSWDLEDMEKYRMQSIRRESRARQKVKGPV
MSQYDNMTPAVQDDLGGIYVIHLRSKSDPGKTGLLSVAEGKESRH
AAKAISPEGEDRFYRRHPEAEMDRAHHHGGHGSTQPEKPSLPQKQ
SSLRSRKLPDMGCSLPEHRAHQEASHRQFCESKNGPPYPQGAGQL
DYGSKGIPDTSEPVSYHNSGVKYAASGQESLRLNHKEVRLSKEME
RPWVRQPSAPEKHSRDCYKEEEHLTQSIVPPPKPERSHSLKLHHTQ
NVERDPSVLYQYQPHGKRQSSVTVVSQYDNLEDYHSLPQHQRGV
FGGGGMGTYVPPGFPHPQSRTYATALGQGAFLPAELSLQHPETQIH
AE |
| Rho GTPase-activating protein 32
Variant 4
SEQ ID NO: 110 | MARGADVPEIPGDLTLKTCGSTASMKVKHVKKLPFTKGHFPKMA
ECAHFYENVEFGSIQLSLSEEQNEVMKNGCESKELVYLVQIACQ
GKSWIVKRSYEDFRVLDKHLHLCIYDRRFSQLSELPRSDTLKDSPE
SVTQMLMAYLSRLSAIAGNKINCGPALTWMEIDNKGNHLLVHEES
SINTPAVGAAHVIKRYTARAPDELTLEVGDIVSVIDMPPKVLSTWW
RGKHGFQVGLFPGHCVELINQKVPQSVTNSVPKPVSKKHGKLITFL
RTFMKSRPTKQKLKQRGILKERVFGCDLGEHLLNSGFEVPQVLQS
CTAFIERYGIVDGIYRLSGVASNIQRLRHEFDSEHVPDLTKEPYVQD
IHSVGSLCKLYFRELPNPLLTYQLYEKFSDAVSAATDEERLIKIHDV
IQQLPPPHYRTLEFLMRHLSLLADYCSITNMHAKNLAIVWAPNLLR
SKQIESACFSGTAAFMEVRIQSVVVEFILNHVDVLFSGRISMAMQE
GAASLSRPKSLLVSSPSTKLLTLEEAQARTQAQVNSPIVTENKYIEV
GEGPAALQGKFHTIIEFPLERKRPQNKMKKSPVGSWRSFFNLGKSS
SVSKRKLQRNESEPSEMKAMALKGGRAEGTLRSAKSEESLTSLHA
VDGDSKLFRPRRPRSSSDALSASFNGEMLGNRCNSYDNLPHDNES
EEEGGLLHIPALMSPHSAEDVDLSPPDIGVASLDFDPMSFQCSPPKA
ESECLESGASFLDSPGYSKDKPSANKKDAETGSSQCQTPGSTASSE
PVSPLQEKLSPFFTLDLSPTEDKSSKPSSFTEKVVYAFSPKIGRKLSK
SPSMSISEPISVTLPPRVSEVIGTVSNTTAQNASSSTWDKCVEERDA
TNRSPTQIVKMKTNETVAQEAYESEVQPLDQVAAEEVELPGKEDQ
SVSSSQSKAVASGQTQTGTVCFPPFFL |
| Rho GTPase-activating protein 32
Variant 5
SEQ ID NO: 111 | MKSSVHSEEDDFVPELHRNVHPRERPDWEETLSAMARGADVPEIP
GDLTLKTCGSTASMKVKHVKKSTTPGLMGCDNIHRLPFTKGHFPK
MAECAHFYENVEFGSIQLSLSEEQNEVMKNGCESKELVYLVQIA
CQGKSWIVKRSYEDFRVLDKHLHLCIYDRRFSQLSELPRSDTL |
| Cytoskeletal Keratin 78 type II
Variant 2
SEQ ID NO: 112 | MEGHEASPAQVGQGDRGKVRFLEQQNKVLETKWHLLQQQGLSG
SQQQGLEPVFEACLDQLRKQLEQLQGERGALDAELKACRDQEEEYK
SKYEEEAHRRATLENDFVVLKKDVDGVFLSKMELEGKLEALREYL
YFLKHLNEEELGQLQTQASDTSVVLSMDNNRYLDFSSIITEVRARY
EEIARSSKAEAEALYQTKYQELQVSAQLHGDRMQETKVQISQLHQ
EIQRLQSQTENLKKQNASLQAAITDAEQRGELALKDAQAKVDELE
AALRMAKQNLARLLCEYQELTSTKLSLDVEIATYRRLLEGEECRM
SGECTSQVTISSVGGSAVMSGGVGGGLGSTCGLGSGKGSPGSCCTS
IVTGGSNIILGSGKDPVLDSCSVSGSSAGSSCHTILKKTVESSLKTSIT
Y |
| Cytoskeletal Keratin 78 type II
Variant 3
SEQ ID NO: 113 | XDVEIATYRRLLEGEECSLGGRQRCHVWRSWWRLGEHLWTR |
| Collagen type VI, alpha 3
Variant 2
SEQ ID NO: 114 | MRKHRHLPLVAVFCLFLSGFPTTHAQQQQAAQDSADIIFLIDGSNN
TGSVNFAVILDFLVNLLEKLPIGTQQIRVGVVQFSDEPRTMFSLDTY
STKAQVLGAVKALGFAGGELANIGLALDFVVENHFTRAGGSRVEE
GVPQVLVLISAGPSSDEIRYGVVALKQASVFSFGLGAQAASRAELQ
HIATDDNLVFTVPEFRSFGDLQEKLLPYIVGVAQRHIVLKPPTIVTQ
VIEVNKRDIVFLVDGSSALGLANFNAIRDFIAKVIQRLEIGQDLIQV
AVAQYADTVRPEFYFNTHPTKREVITAVRKMKPLDGSALYTGSAL
DFVRNNLFTSSAGYRAAEGIPKLLVLITGGKSLDEISQPAQELKRSSI
MAFAIGNKGADQAELEEIAFDSSLVFIPAEFRAAPLQGMLPGLLAP
LRTLSGTPEVHSNKRDIIFLLDGSANVGKTNFPYVRDFVMNLVNSL
DIGNDNIRVGLVQFSDTPVTEFSLNTYQTKSDILGHLRQLQLQGGS
GLNTGSALSYVYANHFTEAGGSRIREHVPQLLLLLTAGQSEDSYLQ
AANALTRAGILTFCVGASQANKAELEQIAFNPSLVYLMDDFSSLPA
LPQQLIQPLTTYVSGGVEEVPLAQPESKRDILFLFDGSANLVGQFPV
VRDFLYKIIDELNVKPEGTRIAVAQYSDDVKVESRFDEHQSKPEILN
LVKRMKIKTGKALNLGYALDYAQRYIFVKSAGSRIEDGVLQFLVL
LVAGRSSDRVDGPASNLKQSGVVPPIFQAKNADPAELEQIVLSPAFI
LAAESLPKIGDLHPQIVNLLKSVHNGAPAPVSGEKDVVFLLDGSEG
VRSGFPLLKEFVQRVVESLDVGQDRVRVAVVQYSDRTRPEFYLNS
YMNKQDVVNAVRQLTLLGGPTPNTGAALEFVLRNILVSSAGSRIT |

TABLE 1-continued

| Protein name/SEQ ID NO. | Amino acid sequence |
|---|---|
| | EGVPQLLIVLTADRSGDDVRNPSVVVKRGGAVPIGIGIGNADITEM
QTISFIPDFAVAIPTFRQLGTVQQVISERVTQLTREELSRLQPVLQPL
PSPGVGGKRDVVFLIDGSQSAGPEFQYVRTLIERLVDYLDVGFDTT
RVAVIQFSDDPKVEFLLNAHSSKDEVQNAVQRLRPKGGRQINVGN
ALEYVSRNIFKRPLGSRIEEGVPQFLVLISSGKSDDEVDDPAVELKQ
FGVAPFTIARNADQEELVKISLSPEYVFSVSTFRELPSLEQKLLTPIT
TLTSEQIQKLLASTRYPPPAVESDAADIVFLIDSSEGVRPDGFAHIRD
FVSRIVRRLNIGPSKVRVGVVQFSNDVFPEFYLKTYRSQAPVLDAI
RRLRLRGGSPLNTGKALEFVARNLFVKSAGSRIEDGVPQHLVLVL
GGKSQDDVSRFAQVIRSSGIVSLGVGDRNIDRTELQTITNDPRLVFT
VREFRELPNIEERIMNSFGPSAATPAPPGVDTPPPSRPEKKKADIVFL
LDGSINFRRDSFQEVLRFVSEIVDTVYEDGDSIQVGLVQYNSDPTD
EFFLKDFSTKRQIIDAINKVVYKGGRHANTKVGLEHLRVNHFVPEA
GSRLDQRVPQIAFVITGGKSVEDAQDVSLALTQRGVKVFAVGVRN
IDSEEVGKIASNSATAFRVGNVQELSELSEQVLETLHDAMHETLCP
GVTDAAKACNLDVILGFDGSRDQNVFVAQKGFESKVDAILNRISQ
MHRVSCSGGRSPTVRVSVVANTPSGPVEAFDFDEYQPEMLEKFRN
MRSQHPYVLTEDTLKVYLNKFRQSSPDSVKVVIHFTDGADGDLAD
LHRASENLRQEGVRALILVGLERVVNLERLMHLEFGRGFMYDRPL
RLNLLDLDYELAEQLDNIAEKACCGVPCKCSGQRGDRGPIGSIGPK
GIPGEDGYRGYPGDEGGPGERGPPGVNGTQGFQGCPGQRGVKGSR
GFPGEKGEVGEIGLDGLDGEDGDKGLPGSSGEKGNPGRRGDKGPR
GEKGERGDVGIRGDPGNPGQDSQERGPKGETGDLGPMGVPGRDG
VPGGPGETGKNGGFGRRGPPGAKGNKGGPGQPGFEGEQGTRGAQ
GPAGPAGPPGLIGEQGISGPRGSGGAAGAPGERGRTGPLGRKGEPG
EPGPKGGIGNRGPRGETGDDGRDGVGSEGRRGKKGERGFPGYPGP
KGNPGEPGLNGTTGPKGIRGRRGNSGPPGIVGQKGDPGYPGPAGP
KGNRGDSIDQCALIQSIKDKCPCCYGPLECPVFPTELAFALDTSEGV
NQDTFGRMRDVVLSIVNDLTIAESNCPRGARVAVVTYNNEVTTEI
RFADSKRKSVLLDKIKNLQVALTSKQQSLETAMSFVARNTFKRVR
NGFLMRKVAVFFSNTPTRASPQLREAVLKLSDAGITPLFLTRQEDR
QLINALQINNTAVGHALVLPAGRDLTDFLENVLTCHVCLDICNIDP
SCGFGSWRPSFRDRRAAGSDVDIDMAFILDSAETTTLFQFNEMKK
YIAYLVRQLDMSPDPKASQHFARVAVVQHAPSESVDNASMPPVK
VEFSLTDYGSKEKLVDFLSRGMTQLQGTRALGSAIEYTIENVFESA
PNPRDLKIVVLMLTGEVPEQQLEEAQRVILQAKCKGYFFVVLGIGR
KVNIKEVYTFASEPNDVFFKLVDKSTELNEEPLMRFGRLLPSFVSSE
NAFYLSPDIRKQCDWFQGDQPTKNLVKFGHKQVNVPNNVTSSPTS
NPVTTTKPVTTTKPVTTTKPVTTTTKPVTIINQPSVKPAAAKPAPA
KPVAAKPVATKMATVRPPVAVKPATAAKPVAAKPAAVRPPAAAA
AKPVATKPEVPRPQAAKPAATKPATTKPMVKMSREVQVFEITENS
AKLHWERAEPPGPYFYDLTVTSAHDQSLVLKQNLTVTDRVIGGLL
AGQTYHVAVVCYLRSQVRATYHGSFSTKKSQPPPPQPARSASSSTI
NLMVSTEPLALTETDICKLPKDEGTCRDFILKWYYDPNTKSCARF
WYGGCGGNENKFGSQKECEVCAPVLAKPGVISVMGT |
| Collagen type VI, alpha 3
Variant 3
SEQ ID NO: 115 | MRKHRHLPLVAVFCLFLSGFPTTHAQQQQAAQDSADIIFLIDGSNN
TGSVNFAVILDFLVNLLEKLPIGTQQIRVGVVQFSDEPRTMFSLDTY
STKAQVLGAVKALGFAGGELANIGLALDFVVENHFTRAGGSRVEE
GVPQVLVLISAGPSSDEIRYGVVALKQASVFSFGLGAQAASRAELQ
HIATDDNLVFTVPEFRSFGDLQEKLLPYIVGVAQRHIVLKPPTIVTQ
VIEVNKRDIVFLVDGSSALGLANFNAIRDFIAKVIQRLEIGQDLIQV
AVAQYADTVRPEFYFNTHPTKREVITAVRKMKPLDGSALYTGSAL
DFVRNNLFTSSAGYRAAEGIPKLLVLITGGKSLDEISQPAQELKRSSI
MAFAIGNKGADQAELEEIAFDSSLVFIPAEFRAAPLQGMLPGLLAP
LRTLSGTPEVHSNKRDIIFLLDGSANVGKTNFPYVRDFVMNLVNSL
DIGNDNIRVGLVQFSDTPVTEFSLNTYQTKSDILGHLRQLQLQGGS
GLNTGSALSYVYANHFTEAGGSRIREHVPQLLLLLLTAGQSEDSYLQ
AANALTRAGILTFCVGASQANKAELEQIAFNPSLVYLMDDFSSLPA
LPQQLIQPLTTYVSGGVEEVPLAQPESKRDILFLFDGSANLVGQFPV
VRDFLYKIIDELNVKPEGTRIAVAQYSDDVKVESRFDEHQSKPEILN
LVKRMKIKTGKALNLGYALDYAQRYIFVKSAGSRIEDGVLQFLVL
LVAGRSSDRVDGPASNLKQSGVVPFIFQAKNADPAELEQIVLSPAFI
LAAESLPKIGDLHPQIVNLLKSVHNGAPAPVSGEKDVVFLLDGSEG
VRSGFPLLKEFVQRVVESLDVGQDRVRVAVVQYSDRTRPEFYLNS
YMNKQDVVNAVRQLTLLGGPTPNTGAALEFVLRNILVSSAGSRIT
EGVPQLLIVLTADRSGDDVRNPSVVVKRGGAVPIGIGIGNADITEM
QTISFIPDFAVAIPTFRQLGTVQQVISERVTQLTREELSRLQPVLQPL
PSPGVGGKRDVVFLIDGSQSAGPEFQYVRTLIERLVDYLDVGFDTT
RVAVIQFSDDPKVEFLLNAHSSKDEVQNAVQRLRPKGGRQINVGN
ALEYVSRNIFKRPLGSRIEEGVPQFLVLISSGKSDDEVDDPAVELKQ
FGVAPFTIARNADQEELVKISLSPEYVFSVSTFRELPSLEQKLLTPIT
TLTSEQIQKLLASTRYPPPAVESDAADIVFLIDSSEGVRPDGFAHIRD
FVSRIVRRLNIGPSKVRVGVVQFSNDVFPEFYLKTYRSQAPVLDAI
RRLRLRGGSPLNTGKALEFVARNLFVKSAGSRIEDGVPQHLVLVL
GGKSQDDVSRFAQVIRSSGIVSLGVGDRNIDRTELQTITNDPRLVFT
VREFRELPNIEERIMNSFGPSAATPAPPGVDTPPPSRPEKKKADIVFL
LDGSINFRRDSFQEVLRFVSEIVDTVYEDGDSIQVGLVQYNSDPTD |

TABLE 1-continued

| Protein name/SEQ ID NO. | Amino acid sequence |
|---|---|
| | EFFLKDFSTKRQIIDAINKVVYKGGRHANTKVGLEHLRVNHFVPEA
GSRLDQRVPQIAFVITGGKSVEDAQDVSLALTQRGVKVFAVGVRN
IDSEEVGKIASNSATAFRVGNVQELSELSEQVLETLHDAMHETLCP
GVTDAAKACNLDVILGFDGSRDQNVFVAQKGFESKVDAILNRISQ
MHRVSCSGGRSPTVRVSVVANTPSGPVEAFDFDEYQPEMLEKFRN
MRSQHPYVLTEDTLKVYLNKFRQSSPDSVKVVIHFTDGADGDLAD
LHRASENLRQEGVRALILVGLERVVNLERLMHLEFGRGFMYDRPL
RLNLLDLDYELAEQLDNIAEKACCGVPCKCSGQRGDRGPIGSIGPK
GIPGEDGYRGYPGDEGGPGERGPPGVNGTQGFQGCPGQRGVKGSR
GFPGEKGEVGEIGLDGLDGEDGDKGLPGSSGEKGNPGRRGDKGPR
GEKGERGDVGIRGDPGNPGQDSQERGPKGETGDLGPMGVPGRDG
VPGGPGETGKNGGFGRRGPPGAKGNKGGPGQPGFEGEQGTRGAQ
GPAGPAGPPGLIGEQGISGPRGSGGAAGAPGERGRTGPLGRKGEPG
EPGPKGGIGNRGPRGETGDDGRDGVGSEGRRGKKGERGFPGYPGP
KGNPGEPGLNGTTGPKGIRGRRGNSGPPGIVGQKGDPGYPGPAGP
KGNRGDSIDQCALIQSIKDKCPCCYGPLECPVFPTELAFALDTSEGV
NQDTFGRMRDVVLSIVNDLTIAESNCPRGARVAVVTYNNEVTTEI
RFADSKRKSVLLDKIKNLQVALTSKQQSLETAMSFVARNTFKRVR
NGFLMRKVAVFFSNTPTRASPQLREAVLKLSDAGITPLFLTRQEDR
QLINALQINNTAVGHALVLPAGRDLTDFLENVLTCHVCLDICNIDP
SCGFGSWRPSFRDRRAAGSDVDIDMAFILDSAETTTLFQFNEMKK
YIAYLVRQLDMSPDPKASQHFARVAVVQHAPSESVDNASMPPVK
VEFSLTDYGSKEKLVDFLSRGMTQLQGTRALGSAIEYTIENVFESA
PNPRDLKIVVLMLTGEVPEQQLEEAQRVILQAKCKGYFFVVLGIGR
KVNIKEVYTFASEPNDVFFKLVDKSTELNEEPLMRFGRLLPSFVSSE
NAFYLSPDIRKQCDWFQGDQPTKNLVKFGHKQVNVPNNVTSSPTS
NPVTTTKPVTTTKPVTTTTKPVTTTTKPVTIINQPSVKPAAAKPAPA
KPVAAKPVATKMATVRPPVAVKPATAAKPVAAKPAAVRPPAAAA
AKPVATKPEVPRPQAAKPAATKPATTKPMVKMSREVQVFEITENS
AKLHWERAEPPGPYFYDLTVTSAHDQSLVLKQNLTVTDRVIGGLL
AGQTYHVAVVCYLRSQVRATYHGSFSTKKSQPPPPQPARSASSSTI
NLMVSTEPLALTETDICKLPKDEGTCRDFILKWYYDPNTKSCARF
WYGGCGGNENKFGSQKECEKVCAPVLAKPGVISVMGT |
| Collagen type VI, alpha 3
Variant 4
SEQ ID NO: 116 | MRKHRHLPLVAVFCLFLSGFPTTHAQQQQAVIEVNKRDIVFLVDG
SSALGLANFNAIRDFIAKVIQRLEIGQDLIQVAVAQYADTVRPEFYF
NTHPTKREVITAVRKMKPLDGSALYTGSALDFVRNNLFTSSAGYR
AAEGIPKLLVLITGGKSLDEISQPAQELKRSSIMAFAIGNKGADQAE
LEEEIAFDSSLVFIPAEFRAAPLQGMLPGLLAPLRTLSGTPEESKRDIL
FLFDGSANLVGQFPVVRDFLYKIIDELNVKPEGTRIAVAQYSDDVK
VESRFDEHQSKPEILNLVKRMKIKTGKALNLGYALDYAQRYIFVKS
AGSRIEDGVLQFLVLLVAGRSSDRVDGPASNLKQSGVVPPIFQAKN
ADPAELEQIVLSPAFILAAESLPKIGDLHPQIVNLLKSVHNGAPAPV
SGEKDVVFLLDGSEGVRSGFPLLKEFVQRVVESLDVGQDRVRVAV
VQYSDRTRPEFYLNSYMNKQDVVNAVRQLTLLGGPTPNTGAALE
FVLRNILVSSAGSRITEGVPQLLIVLTADRSGDDVRNPSVVVKRGG
AVPIGIGIGNADITEMQTISFIPDFAVAIPTFRQLGTVQQVISERVTQL
TREELSRLQPVLQPLPSPGVGGKRDVVFLIDGSQSAGPEFQYVRTLI
ERLVDYLDVGFDTTRVAVIQFSDDPKVEFLLNAHSSKDEVQNAVQ
RLRPKGGRQINVGNALEYVSRNIFKRPLGSRIEEGVPQFLVLISSGK
SDDEVDDPAVELKQFGVAPFTIARNADQEELVKISLSPEYVFSVSTF
RELPSLEQKLLTPITTLTSEQIQKLLASTRYPPPAVESDAADIVFLIDS
SEGVRPDGFAHIRDFVSRIVRRLNIGPSKVRVGVVQFSNDVFPEFYL
KTYRSQAPVLDAIRRLRLRGGSPLNTGKALEFVARNLFVKSAGSRI
EDGVPQHLVLVLGGKSQDDVSRFAQVIRSSGIVSLGVGDRNIDRIL
LQTITNDPRLVFTVREFRELPNIEERIMNSFGPSAATPAPPGVDTPPP
SRPEKKKADIVFLLDGSINFRRDSFQEVLRFVSEIVDTVYEDGDSIQ
VGLVQYNSDPTDEFFLKDFSTKRQIIDAINKVVYKGGRHANTKVG
LEHLRVNHFVPEAGSRLDQRVPQIAFVITGGKSVEDAQDVSLALTQ
RGVKVFAVGVRNIDSEEVGKIASNSATAFRVGNVQELSELSEQVLE
TLHDAMHETLCPGVTDAAKACNLDVILGFDGSRDQNVFVAQKGF
ESKVDAILNRISQMHRVSCSGGRSPTVRVSVVANTPSGPVEAFDFD
EYQPEMLEKFRNMRSQHPYVLTEDTLKVYLNKFRQSSPDSVKVVI
HFTDGADGDLADLHRASENLRQEGVRALILVGLERVVNLERLMH
LEFGRGFMYDRPLRLNLLDLDYELAEQLDNIAEKACCGVPCKCSG
QRGDRGPIGSIGPKGIPGEDGYRGYPGDEGGPGERGPPGVNGTQGF
QGCPGQRGVKGSRGFPGEKGEVGEIGLDGLDGEDGDKGLPGSSGE
KGNPGRRGDKGPRGEKGERGDVGIRGDPGNPGQDSQERGPKGET
GDLGPMGVPGRDGVPGGPGETGKNGGFGRRGPPGAKGNKGGPG
QPGFEGEQGTRGAQGPAGPAGPPGLIGEQGISGPRGSGGAAGAPGE
RGRTGPLGRKGEPGEPGPKGGIGNRGPRGETGDDGRDGVGSEGRR
GKKGERGFPGYPGPKGNPGEPGLNGTTGPKGIRGRRGNSGPPGIVG
QKGDPGYPGPAGPKGNRGDSIDQCALIQSIKDKCPCCYGPLECPVF
PTELAFALDTSEGVNQDTFGRMRDVVLSIVNDLTIAESNCPRGARV
AVVTYNNEVTTEIRFADSKRKSVLLDKIKNLQVALTSKQQSLETA
MSFVARNTFKRVRNGFLMRKVAVFFSNTPTRASPQLREAVLKLSD
AGITPLFLTRQEDRQLINALQINNTAVGHALVLPAGRDLTDFLENV
LTCHVCLDICNIDPSCGFGSWRPSFRDRRAAGSDVDIDMAFILDSA |

TABLE 1-continued

| Protein name/SEQ ID NO. | Amino acid sequence |
| --- | --- |
| | ETTTLFQFNEMKKYIAYLVRQLDMSPDPKASQHFARVAVVQHAPS<br>ESVDNASMPPVKVEFSLTDYGSKEKLVDFLSRGMTQLQGTRALGS<br>AIEYTIENVFESAPNPRDLKIVVLMLTGEVPEQQLEEAQRVILQAKC<br>KGYFFVVLGIGRKVNIKEVYTFASEPNDVFFKLVDKSTELNEEPLM<br>RFGRLLPSFVSSENAFYLSPDIRKQCDWFQGDQPTKNLVKFGHKQ<br>VNVPNNVTSSPTSNPVTTTKPVTTTKPVTTTTKPVTTTTKPVTIINQ<br>PSVKPAAAKPAPAKPVAAKPVATKMATVRPPVAVKPATAAKPVA<br>AKPAAVRPPAAAAAKPVATKPEVRPQAAKPAATKPATTKPMVK<br>MSREVQVFEITENSAKLHWERAEPPGPYFYDLTVTSAHDQSLVLK<br>QNLTVTDRVIGGLLAGQTYHVAVVCYLRSQVRATYHGSFSTKKSQ<br>PPPPQPARSASSSTINLMVSTEPLALTETDICKLPKDEGTCRDFILKW<br>YYDPNTKSCARFWYGGCGGNENKFGSQKECEKVCAPVLAKPGVI<br>SVMGT |
| Collagen type VI, alpha 3<br>Variant 5<br>SEQ ID NO: 117 | MRKHRHLPLVAVFCLFLSGFPTTHAQQQQAAQDSADIIFLIDGSNN<br>TGSVNFAVILDFLVNLLEKLPIGTQQIRVGVVQFSDEPRTMFSLDTY<br>STKAQVLGAVKALGFAGGELANIGLALDFVVENHFTRAGGSRVEE<br>GVPQVLVLISAGPSSDEIRYGVVALKQASVFSFGLGAQAASRAELQ<br>HIATDDNLVFTVPEFRSFGDLQEKLLPYIVGVAQRHIVLKPPTIVTQ<br>VIEVNKRDIVFLVDGSSALGLANFNAIRDFIAKVIQRLEIGQDLIQV<br>AVAQYADTVRPEFYFNTHPTKREVITAVRKMKPLDGSALYTGSAL<br>DFVRNNLFTSSAGYRAAEGIPKLLVLITGGKSLDEISQPAQELKRSSI<br>MAFAIGNKGADQAELEEIAFDSSLVFIPAEFRAAPLQGMLPGLLAP<br>LRTLSGTPEVHSNKRDIIFLLDGSANVGKTNFPYVRDFVMNLVNSL<br>DIGNDNIRVGLVQFSDTPVTEFSLNTYQTKSDILGHLRQLQLQGGS<br>GLNTGSALSYVYANHFTEAGGSRIREHVPQLLLLLLTAGQSEDSYLQ<br>AANALTRAGILTFCVGASQANKAELEQIAFNPSLVYLMDDFSSLPA<br>LPQQLIQPLTTYVSGGVEEVPLAQPESKRDILFLFDGSANLVGQFPV<br>VRDPFLYKIIDELNVKPEGTRIAVAQYSDDVKVESRFDEHQSKPEILN<br>LVKRMKIKTGKALNLGYALDYAQRYIFVKSAGSRIEDGVLQFLVL<br>LVAGRSSDRVDGPASNLKQSGVVPPFIFQAKNADPAELEQIVLSPAFI<br>LAAESLPKIGDLHPQIVNLLKSVHNGAPAPVSGEKDVVFLLDGSEG<br>VRSGFPLLKEFVQRVVESLDVGQDRVRVAVVQYSDRTRPEFYLNS<br>YMNKQDVVNAVRQLTLLGGPTPNTGAALEFVLRNILVSSAGSRIT<br>EGVPQLLIVLTADRSGDDVRNPSVVVKRGGAVPIGIGIGNADITEM<br>QTISFIPDFAVAIPTFRQLGTVQQVISERVTQLTREELSRLQPVLQPL<br>PSPGVGGKRDVVFLIDGSQSAGPEFQYVRTLIERLVDYLDVGFDTT<br>RVAVIQFSDDPKVEFLLNAHSSKDEVQNAVQRLRPKGGRQINVGN<br>ALEYVSRNIFKRPLGSRIEEGVPQFLVLISSGKSDDEVDDPAVELKQ<br>FGVAPFTIARNADQEELVKISLSPEYVFSVSTFRELPSLEQKLLTPIT<br>TLTSEQIQKLLASTRYPPPGEMGASEVLLGAFSI |
| Collagen type VI, alpha 3<br>Variant 6<br>SEQ ID NO: 118 | MRKHRHLPLVAVFCLFLSGFPTTHAQQQQAVIEVNKRDIVFLVDG<br>SSALGLANFNAIRDFIAKVIQRLEIGQDLIQVAVAQYADTVRPEFYF<br>NTHPTKREVITAVRKMKPLDGSALYTGSALDFVRNNLFTSSAGYR<br>AAEGIPKLLVLITGGKSLDEISQPAQELKRSSIMAFAIGNKGADQAE<br>LEEIAFDSSLVFIPAEFRAAPLQGMLPGLLAPLRTLSGTPEVHSNKR<br>DIIFLLDGSANVGKTNFPYVRDFVMNLVNSLDIGNDNIRVGLVQFS<br>DTPVTEFSLNTYQTKSDILGHLRQLQLQGGSGLNTGSALSYVYAN<br>HFTEAGGSRIREHVPQLLLLLLTAGQSEDSYLQAANALTRAGILTFC<br>VGASQANKAELEQIAFNPSLVYLMDDFSSLPALPQQLIQPLTTYVS<br>GGVEEVPLAQPESKRDILFLFDGSANLVGQFPVVRDFLYKIIDELNV<br>KPEGTRIAVAQYSDDVKVESRFDEHQSKPEILNLVKRMKIKTGKAL<br>NLGYALDYAQRYIFVKSAGSRIEDGVLQFLVLLVAGRSSDRVDGP<br>ASNLKQSGVVPFIFQAKNADPAELEQIVLSPAFILAAESLPKIGDLH<br>PQIVNLLKSVHNGAPAPVSGEKDVVFLLDGSEGVRSGFPLLKEFVQ<br>RVVESLDVGQDRVRVAVVQYSDRTRPEFYLNSYMNKQDVVNAV<br>RQLTLLGGPTPNTGAALEFVLRNILVSSAGSRITEGVPQLLIVLTAD<br>RSGDDVRNPSVVVKRGGAVPIGIGIGNADITEMQTISFIPDFAVAIPT<br>FRQLGTVQQVISERVTQLTREELSRLQPVLQPLPSPGVGGKRDVVF<br>LIDGSQSAGPEFQYVRTLIERLVDYLDVGFDTTRVAVIQFSDDPKV<br>EFLLNAHSSKDEVQNAVQRLRPKGGRQINVGNALEYVSRNIFKRP<br>LGSRIEEGVPQFLVLISSGKSDDEVDDPAVELKQFGVAPFTIARNAD<br>QEELVKISLSPEYVFSVSTFRELPSLEQKLLTPITTLTSEQIQKLLAST<br>RYPPPGEMGASEVLLGAFSI |
| Collagen type VI, alpha 3<br>Variant 7<br>SEQ ID NO: 119 | MRKHRHLPLVAVFCLFLSGFPTTHAQQQQAVIEVNKRDIVFLVDG<br>SSALGLANFNAIRDFIAKVIQRLEIGQDLIQVAVAQYADTVRPEFYF<br>NTHPTKREVITAVRKMKPLDGSALYTGSALDFVRNNLFTSSAGYR<br>AAEGIPKLLVLITGGKSLDEISQPAQELKRSSIMAFAIGNKGADQAE<br>LEEIAFDSSLVFIPAEFRAAPLQGMLPGLLAPLRTLSGTPEESKRDIL<br>FLFDGSANLVGQFPVVRDFLYKIIDELNVKPEGTRIAVAQYSDDVK<br>VESRFDEHQSKPEILNLVKRMKIKTGKALNLGYALDYAQRYIFVKS<br>AGSRIEDGVLQFLVLLVAGRSSDRVDGPASNLKQSGVVPFIFQAKN<br>ADPAELEQIVLSPAFILAAESLPKIGDLHPQIVNLLKSVHNGAPAPV<br>SGEKDVVFLLDGSEGVRSGFPLLKEFVQRVVESLDVGQDRVRVAV<br>VQYSDRTRPEFYLNSYMNKQDVVNAVRQLTLLGGPTPNTGAALE<br>FVLRNILVSSAGSRITEGVPQLLIVLTADRSGDDVRNPSVVVKRGG |

TABLE 1-continued

| Protein name/SEQ ID NO. | Amino acid sequence |
|---|---|
| | AVPIGIGIGNADITEMQTISFIPDFAVAIPTFRQLGTVQQVISERVTQL
TREELSRLQPVLQPLPSPGVGGKRDVVFLIDGSQSAGPEFQYVRTLI
ERLVDYLDVGFDTTRVAVIQFSDDPKVEFLLNAHSSKDEVQNAVQ
RLRPKGGRQINVGNALEYVSRNIFKRPLGSRIEEGVPQFLVLISSGK
SDDEVDDPAVELKQFGVAPFTIARNADQEELVKISLSPEYVFSVSTF
RELPSLEQKLLTPITTLTSEQIQKLLASTRYPPPAVESDAADIVFLIDS
SEGVRPDGFAHIRDFVSRIVRRLNIGPSKVRVGVVQFSNDVFPEFYL
KTYRSQAPVLDAIRRLRLGGSPLNTGKALEFVARNLFVKSAGSRI
EDGVPQHLVLVLGGKSQDDVSRFAQVIRSSGIVSLGVGDRNIDRTE
LQTITNDPRLVFTVREFRELPNIEERIMNSFGPSAATPAPPGVDTPPP
SRPEKKKADIVFLLDGSINFRRDSFQEVLRFVSEIVDTVYEDGDSIQ
VGLVQYNSDPTDEFFLKDFSTKRQIIDAINKVVYKGGRHANTKVG
LEHLRVNHFVPEAGSRLDQRVPQIAFVITGGKSVEDAQDVSLALTQ
RGVKVFAVGVRNIDSEEVGKIASNSATAFRVGNVQELSELSEQVLE
TLHDAMHETLCPGVTDAAKACNLDVILGFDGSRDQNVFVAQKGF
ESKVDAILNRISQMHRVSCSGGRSPTVRVSVVANTPSGPVEAFDFD
EYQPEMLEKFRNMRSQHPYVLTEDTLKVYLNKFRQSSPDSVKVVI
HFTDGADGDLADLHRASENLRQEGVRALILVGLERVVNLERLMH
LEFGRGFMYDRPLRLNLLDLDYELAEQLDNIAEKACCGVPCKCSG
QRGDRGPIGSIGPKGIPGEDGYRGYPGDEGGPGERGPPGVNGTQGF
QGCPGQRGVKGSRGFPGEKGEVGEIGLDGLDGEDGDKGLPGSSGE
KGNPGRRGDKGPRGEKGERGDVGIRGDPGNPGQDSQERGPKGET
GDLGPMGVPGRDGVPGGPGETGKNGGFGRRGPPGAKGNKGGPG
QPGFEGEQGTRGAQGPAGPAGPPGLIGEQGISGPRGSGGAAGAPGE
RGRTGPLGRKGEPGEPGPKGGIGNRGPRGETGDDGRDGVGSEGRR
GKKGERGFPGYPGPKGNPGEPGLNGTTGPKGIRGRRGNSGPPGIVG
QKGDPGYPGPAGPKGNRGDSIDQCALIQSIKDKCPFHGPLECPVFP
IELAFALDTSEGVNQDTFGRMRDVVLSIVNDLTIAESNCPRGARV
AVVTYNNEVTTEIRFADSKRKSVLLDKIKNLQVALTSKQQSLETA
MSFVARNTFKRVRNGFLMRKVAVFFSNTPTRASPQLREAVLKLSD
AGITPLFLTRQEDRQLINALQINNTAVGHALVLPAGRDLTDFLENV
LTCHVCLDICNIDPSCGFGSWRPSFRDRRAAGSDVDIDMAFILDSA
ETTTLFQFNEMKKYIAYLVRQLDMSPDPKASQHFARVAVVQHAPS
ESVDNASMPPVKVEFSLTDYGSKEKLVDFLSRGMTQLQGTRALGS
AIEYTIENVFESAPNPRDLKIVVLMLTGEVPEQQLEEAQRVILQAKC
KGYFFVVLGIGRKVNIKEVYTFASEPNDVFFKLVDKSTELNEEPLM
RFGRLLPSFVSSENAFYLSPDIRKQCDWFQGDQPTKNLVKFGHKQ
VNVPNNVTSSPTSNPVTTTKPVTTTKPVTTTTKPVTTTTKPVTIINQ
PSVKPAAAKPAPAKPVAAKPVATKMATVRPPVAVKPATAAKPVA
AKPAAVRPPAAAAAKPVATKPEVPRPQAAKPAATKPATTKPMVK
MSREVQVFEITENSAKLHWERAEPPGPYFYDLTVTSAHDQSLVLK
QNLTVTDRVIGGLLAGQTYHVAVVCYLRSQVRATYHGSFSTKKSQ
PPPPQPARSASSSTINLMVSTEPLALTETDICKLPKDEGTCRDFILKW
YDPNTKSCARFWYGGCGGNENKFGSQKECEKVCAPVLAKPGVI
SVMGT |
| Collagen type VI, alpha 3
Variant 8
SEQ ID NO: 120 | MRKHRHLPLVAVFCLFLSGFPTTHAQQQQADVKNGAAADIIFLVD
SSWTIGEEHFQLVREFLYDVVKSLAVGENDFHFALVQFNGNPHTE
FLLNTYRTKQEVLSHISNMSYIGGTNQTGKGLEYIMQSHLTKAAGS
RAGDGVPQVIVVLTDGHSKDGLALPSAELKSADVNVFAIGVEDAD
EGALKEIASEPLNMHMFNLENFTSLHDIVGNLVSCVHSSVSPERAG
DIETLKDITAQDSADIIFLIDGSNNTGSVNFAVILDFLVNLLEKLPIG
TQQIRVGVVQFSDEPRTMFSLDTYSTKAQVLGAVKALGFAGGELA
NIGLALDFVVENHFTRAGGSRVEEGVPQVLVLISAGPSSDEIRYGV
VALKQASVFSFGLGAQAASRAELQHIATDDNLVFTVPEFRSFGDLQ
EKLLPYIVGVAQRHIVLKPPTIVTQVIEVNKRDIVFLVDGSSALGLA
NFNAIRDFIAKVIQRLEIGQDLIQVAVAQYADTVRPEFYFNTHPTKR
EVITAVRKMKPLDGSALYTGSALDFVRNNLFTSSAGYRAAEGIPKL
LVLITGGKSLDEISQPAQELKRSSIMAFAIGNKGADQAELEEIAFDS
SLVFIPAEFRAAPLQGMLPGLLAPLRTLSGTPEESKRDILFLFDGSA
NLVGQFPVVRDFLYKIIDELNVKPEGTRIAVAQYSDDVKVESRFDE
HQSKPEILNLVKRMKI |
| Collagen type VI, alpha 3
Variant 9
SEQ ID NO: 121 | PIGTQQIRVGVVQFSDEPRTMFSLDTYSTKAQVLGAVKALGFAGG
ELANIGLALDFVVENHFTRAGGSRVEEGVPQVLVLISAGPSSDEIRY
GVVALKQASVFSFGLGAQAASRAELQHIATDDNLVFTVPEFRSFG
DLQEKLLPYIVGVAQRHIVLKPPTIVTQEYGLNENW |
| Proteasome subunit beta type-5
Variant 2
SEQ ID NO: 122 | MALASVLERPLPVNQRGFFGLGGRADLLDLGPGSLSDGLSLAAPG
WGVPEEPGIEMLHGTTTLAFKFRHGVIVAADSRATAGAYIASQTV
KKVIEINPYLLGTMAGGAADCSFWERLLARQCRIYELRNKERISVA
AASKLLANMVYQYKGMGLSMGTMICGWDKRGPVSEVLCLKPKS
FGMYLFCGAERIGNMARPLLRGQ |
| Proteasome subunit beta type-5
Variant 3
SEQ ID NO: 123 | MAGGAADCSFWERLLARQCRIYELRNKERISVAAASKLLANMVY
QYKGMGLSMGTMICGWDKRGPGLYYVDSEGNRISGATFSVGSGS
VYAYGVMDRGYSYDLEVEQAYDLARRAIYQATYRDAYSGGAVN
LYHVREDGWIRVSSDNVADLHEKYSGSTP |

TABLE 1-continued

| Protein name/SEQ ID NO. | Amino acid sequence |
| --- | --- |
| Proteasome subunit beta type-5 Variant 4 SEQ ID NO: 124 | MALASVLERPLPVNQRGFFGLGGRADLLDLGPGSLSDGLSLAAPG WGVPEEPGIEMLHGTTTLAFKASTTWTVKGTGFQGPPSL |
| Proteasome subunit beta type-5 Variant 5 SEQ ID NO: 125 | XGIEMLHGTTTLAFKFRHGVIVAADSRATAGAYIASQTVKKVIEIN PYLLGTMAGGAADCSFWERLLARQCRIYELRNKERISVAAASKLL ANMVYQYKGMGLSMGTMICGWDKRGPG |
| Heterogeneous nuclear ribonucleoproteins A2/B1 Variant 2 SEQ ID NO: 126 | MEREKEQFRKLFIGGLSFETTEESLRNYYEQWGKLTDCVVMRDPA SKRSRGFGFVTFSSMAEVDAAMAARPHSIDGRVVEPKRAVAREES GKPGAHVTVKKLFVGGIKEDTEEHHLRDYFEEYGKIDTIEIITDRQS GKKRGFGFVTFDDHDPVDKIVLQKYHTINGHNAEVRKALSRQEM QEVQSSRSGRGGNFGFGDSRGGGNFGPGPGSNFRGGSDGYGSGR GFGDGYNGYGGGPGGGNFGGSPGYGGGRGGYGGGGPGYGNQGG GYGGGYDNYGGGNYGSGNYNDFGNYNQQPSNYGPMKSGNFGGS RNMGGPYGGGNYGPGGSGGSGGYGGRSRY |
| Heterogeneous nuclear ribonucleoproteins A2/B1 Variant 3 SEQ ID NO: 127 | MEREKEQFRKLFIGGLSFETTEESLRNYYEQWGKLTDCVVMRDPA SKRSRGFGFVTFSSMAEVDAAMAARPHSIDGRVVEPKRAVAREES GKPGAHVTVKKLFVGGIKEDTEEHHLRDYFEEYGKIDTIEIITDRQS GKKRGFGFVTFDDHDPVDKIVLQKYHTINGHNAEVRKALSRQEM QEVQSSRSGRGGNFGFGDSRGGGNFGPGPGSNFRGGSDGYGSGR GFGDGYNGYGGGPGGGNFGGSPGYGGGRGGYGGGGPGYGNQGG GYGGGYDNYGGGNYGSGNYNDFGNYNQQPSNYGPMKSGNFGGS RNMGGPYGGGNYGPGGSGGSGGYGGRSRY |
| Heterogeneous nuclear ribonucleoproteins A2/B1 Variant 4 SEQ ID NO: 128 | MEKTLETVPLERKKREKEQFRKLFIGGLSFETTEESLRNYYEQWGK LTDCVVMRDPASKRSRGFGFVTFSSMAEVDAAMAARPHSIDGRV VEPKRAVAREESGKPGAHVTVKKLFVGGIKEDTEEHHLRDYFEEY GKIDTIEIITDRQSGKKRGFGFVTFDDHDPVDKIVLQKYHTINGHNA EVRKALSRQEMQEDLEVAILEVAPVMEEEEEDMVVEDLDMATRV GATEVVMTTMEEEIMEVEITMILEIITSNLLTTVQ |
| Beta enolase Variant 2 SEQ ID NO: 129 | MAMQKIFAREILDSRGNPTVEVDLHTAKGRFAAVPSGASTGIYE ALELRDGDKGRYLGKGVLKAVENINNTLGPALLQKKLSVVDQEK VDKFMIELDGTENKSKFGANAILGVSLAVCKAGAAEKGVPLYRHI ADLAGNPDLILPVPAFNVINGGSHAGNKLAMQEFMILPVGASSFKE AMRIGAEVYHHLKGVIKAKYGKDATNVGDEGGFAPNILENNEAL ELLKTAIQAAGYPDKVVIGMDVAASEFYRNGKYDLDFKSPDDPAR HITGEKLGELYKSFIKNYPVVSIEDPFDQDDWATWTSFLSGVNIQIV GDDLTVTNPKRIAQAVEKKACNCLLLKVNQIGSVTESIQACKLAQS NGWGVMVSHRSGETEDTFIADLVVGLCTGQIKTGAPCRSERLAKY NQLMRIEEALGDKAIFAGRKFRNPKAK |
| Beta enolase Variant 3 SEQ ID NO: 130 | MAMQKIFAREILDSRGNPTVEVDLHTAKGRFAAVPSGASTGIYE ALELRDGDKGRYLGKGVLKAVENINNTLGPALLQKKLSVVDQEK VDKFMIELDGTENKSKFGANAILGVSLAVCKAGAAEKGVPLYRHI ADLAGNPDLILPVPAFNVINGGSHAGNKLAMQEFMILPVGASSFKE AMRIGAEVYHHLKGVIKAKYGKDATNVGDEGGFAPNILENNEAL ELLKTAIQAAGYPDKVVIGMDVAASEFYRNGKYDLDFKSPDDPAR HITGEKLGELYKSFIKNYPVVSIEDPFDQDDWATWTSFLSGVNIQIV GDDLTVTNPKRIAQAVEKKACNCLLLKVNQIGSVTESIQACKLAQS NGWGVMVSHRSGETEDTFIADLVVGLCTGQIKTGAPCRSERLAKY NQLMRIEEALGDKAIFAGRKFRNPKAK |
| Beta enolase Variant 4 SEQ ID NO: 131 | MAMQKIFAREILDSRGNPTVEVDLHTAKGRFAAVPSGASTGIYE ALELRDGDKGRYLGKAKFGANAILGVSLAVCKAGAAEKGVPLYR HIADLAGNPDLILPVPAFNVINGGSHAGNKLAMQEFMILPVGASSF KEAMRIGAEVYHHLKGVIKAKYGKDATNVGDEGGFAPNILENNE ALELLKTAIQAAGYPDKVVIGMDVAASEFYRNGKYDLDFKSPDDP ARHITGEKLGELYKSFIKNYPVVSIEDPFDQDDWATWTSFLSGVNI QIVGDDLTVTNPKRIAQAVEKKACNCLLLKVNQIGSVTESIQACKL AQSNGWGVMVSHRSGETEDTFIADLVVGLCTGQIKTGAPCRSERL AKYNQLMRIEEALGDKAIFAGRKFRNPKAK |
| Beta enolase Variant 5 SEQ ID NO: 132 | MAMQKIFAREILDSRGNPTVEVDLHTAKGRFAAVPSGASTGIYE ALELRDGDKGRYLGKGVLKAVENINNTLGPALLQKKLSVVDQEK VDKFMIELDGTENKSKFGANAILGVSLAVCKAGAAEKGVPLYRHI ADLAGNPDLILPVPAFNVINGGSHAGNKLAMQEFMILPVGASSFKE AMRIGAEVYHHLKGVIKAKYGKDATNVGDEGG |
| Beta enolase Variant 6 SEQ ID NO: 133 | MAMQKIFAREILDSRGNPTVEVDLHTAKGRFAAVPSGASTGIYE ALELRDGDKGRYLGKGVLKAVENINNTLGPALLQKKLSVVDQEK VDKFMIELDGTENKSKFGANAILGVSLAVCKAGAAEKGVPLYRHI ADLAGNPDLILPVPAFNVINGGSHAGNKLAMQEFMILPVGASSFKE AMRIGAEVYHHLKGVI |

TABLE 1-continued

| Protein name/SEQ ID NO. | Amino acid sequence |
|---|---|
| Beta enolase Variant 7 SEQ ID NO: 134 | MAMQKIFAREILDSRGNPTVEVDLHTAKGRFRAAVPSGASTGIYE ALELRDGDKGRYLGKGVLKAVENINNTLGPALLQKKLSVVDQEK VDKFMIELDGTENKSKFGANAILGVSLAVCKAGAAEKGVPLYRHI ADLAGNPDLILPVP |
| Beta enolase Variant 8 SEQ ID NO: 135 | MAMQKIFAREILDSRGNPTVEVDLHTAKGRFRAAVPSGASTGIYE ALELRDGDKGRYLGKGVLKAVENINNTLGPALLQKKLSVVDQEK VDKFMIELDGTENKSKFGANAILGVSLAVCKAGAAEKGVPLYRHI ADLAGNPDLILPVP |
| Beta enolase Variant 9 SEQ ID NO: 136 | MAMQKIFAREILDSRGNPTVEVDLHTAKGRFRAAVPSGASTGIYE ALELRDGDKGRYLGKGVLKAVENINNTLGPALLQKKLSVVDQEK VDKFMIELDGTENKSKFGANAILGVSLAVCKAGAAEKGVPLYRHI ADLAGNPDLILPVPAFNVIN |
| Beta enolase Variant 10 SEQ ID NO: 137 | MAMQKIFAREILDSRGNPTVEVDLHTAK |
| Glutathione 5-transferase P Variant 2 SEQ ID NO: 138 | MPPYTVVYFPVRGRCAALRMLLADQGQSWKEEVVTVETWQEGS LKASCLYGQLPKFQDGDLTLYQSNTILRHLGRTLGLYGKDQQEAA LVDMVNDGVEDLRCKYISLIYTNYISFADYNLLDLLLIHEVLAPGC LDAFPLLSAYVGRLSARPKLKAFLASPEYVNLPINGNGKQ |
| Glutathione 5-transferase P Variant 3 SEQ ID NO: 139 | EAGKDDYVKALPGQLKPFETLLSQNQGGKTFIVGDQVSIWPHAVP SSPPSASRWTQVSPSLTTTCWTCC |
| Glutathione S-transferase Mu 3 Variant 2 SEQ ID NO: 140 | MSCESSMVLGYWDIRGLAHAIRLLLEFTDTSYEEKRYTCGEAPDY DRSQWLDVKFKLDLDFPNLPYLLDGKNKITQSNAILRYIARKHNM CGETEEEKIRVDIIENQVMDFRTQLIRLCYSSDHEKLKPQYLEELPG QLKQFSMFLGKFSWFAGEKLTFVDFLTYD |
| Glutathione S-transferase Mu 3 Variant 3 SEQ ID NO: 141 | MSCESSMVLGYWDIRGLAHAIRLLLEFTDTSYEEKRYTCGEAPDY DRSQWLDVKFKLDLDFPNLPYLLDGKNKITQSNAILRYIARKHNM CGETEEEKIRVDIIENQVMDFRTQLIRLCYSSDHEKLKPQYLEELPG QLKQFSMFLGKFSWFAGEKLTFVDFLTYDILDQNRIFDPKCLDEFP NLKAFMCRFGDVLHFLYKTLTAPLGPADP |
| Rho 23 GTPase-activating protein Variant 2 SEQ ID NO: 142 | MNGVAFCLVGIPPRPEPRPPQLPLGPRDGCSPRRPFPWQGPRTLLL YKSPQDGFGFTLRHFIVYPPESAVHCSLKEEENGGRGGGPSPRYRL EPMDTIFVKNVKEDGPAHRAGLRTGDRLVKVNGESVIGKTYSQVI ALIQNSDDTLELSIMPKDEDILQLAYSQDAYLKGNEPYSGEARSIPE PPPICYPRKTYAPPARASTRATMVPEPTSALPSDPRSPAAWSDPGLR VPPAARAHLDNSSLGMSQPRPSPGAFPHLSSEPRTPRAFPEPGSRVP PSRLECQQALSHWLSNQVPRRAGERRCPAMAPRARSASQDRLEEV AAPRPWPCSTSQDALSQLGQEGWHRARSDDYLSRATRSAEALGPG ALVSPRFERCGWASQRSSARTPACPTRDLPGPQAPPPSGLQGLDDL GYIGYRSYSPSFQRRTGLLHALSFRDSPFGGLPTFNLAQSPASFPPE ASEPPRVVRPEPSTRALEPPAEDRGDEVVLRQKPPTGRKVQLTPAR QMNLGFGDESPEPEASGRGERLGRKVAPLATTEDSLASIPFIDEPTS PSIDLQAKHVPASAVVSSAMNSAPVLGTSPSSPTFTFTLGRHYSQD CSSIKAGRRSSYLLAITTERSKSCDDGLNTFRDEGRVLRRLPNRIPS LRMLRSFFTDGSLDSWGTSEDADAPSKRHSTSDLSDATFSDIRREG WLYYKQILTKKGKKAGSGLRQWKRVYAALRARSLSLSKERREPG PAAAGAAAAGAGEDEAAPVCIGSCLVDISYSETKRRHVFRLTTAD FCEYLFQAEDRDDMLGWIRAIRENSRAEGEDPGCANQALISKKLN DYRKVSHSSGPKADSSPKGSRGLGGLKSEFLKQSAARGLRTQDLP AGSKDDSAAAPKTPWGINIIKKNKKAAPRAFGVRLEECQPATENQ RVPLIVAACCRIVEARGLESTGIYRVPGNNAVVSSLQEQLNRGPGD INLQDERWQDLNVISSLLKSFFRKLPEPLFTDDKYNDFIEANRIEDA RERMRTLRKLIRDLPGHYYETLKFLVGHLKTIADHSEKNKMEPRN LALVFGPTLVRTSEDNMTDMVTHMPDRYKIVETLIQHSDWFFSDE EDKGERTPVGDKEPQAVPNIEYLLPNIGRTVPPGDPGSADLLEI |
| ARHGAP23 Variant 3 SEQ ID NO: 143 | MDTIFVKNVKEDGPAHRAGLRTGDRLVKVNGESVIGKTYSQVIAL IQNSDDTLELSIMPKDEDILQLAYSQDAYLKGNEPYSGEARSIPEPP PICYPRKTYA |
| ARHGAP23 Variant 4 SEQ ID NO: 144 | XFFSDEEDKGERTPVGDKEPQAVPNIEYLLPNIGRTVPPGDPGSDST TCSSAKSKVRMKAILKA |
| ARHGAP23 Variant 5 SEQ ID NO: 145 | XTFSDIRREGWLYYKQILTKKGKAEDRDDMLGWIRAIRENSRAEG EDPGCANQALISKKLNDYRKVSHSSGPKADSSPKGSRGLGGLKSEF LKQSAARGLRTQDLPAGSKDDSAAAPKTPWGINIIKKNKKAAPRA FGVRLEECQPATENQRVPLIVAACCRI |

TABLE 1-continued

| Protein name/SEQ ID NO. | Amino acid sequence |
|---|---|
| ARHGAP23<br>Variant 6<br>SEQ ID NO: 146 | IRDLPGHYYETLKFLVGHLKTIADHSEKNKMEPRNLALVFGPTLVR<br>TSEDNMTDMVTHMPDRYKIVETLIQHSDWFFSDEEDKGERILPPV<br>VQPSPRVRGPPRRSRTPGRCWRSPSSRPSTASARSGGRRGGWAA |
| Rho 32<br>or Rho GTPase-activating protein 32<br>(ARHGAP32)<br>SEQ ID NO: 147 | METESESSTLGDDSVFWLESEVIIQVTDCEEEEREEKFRKMKSSVH<br>SEEDDFVPELHRNVHPRERPDWEETLSAMARGADVPEIPGDLTLK<br>TCGSTASMKVKHVKKLPFTKGHFPKMAECAHFHYENVEFGSIQLS<br>LSEEQNEVMKNGCESKELVYLVQIACQGKSWIVKRSYEDFRVLDK<br>HLHLCIYDRRFSQLSELPRSDTLKDSPESVTQMLMAYLSRLSAIAG<br>NKINCGPALTWMEIDNKGNHLLVHEESSINTPAVGAAHVIKRYTA<br>RAPDELTLEVGDIVSVIDMPPKVLSTWWRGKHGFQVGLFPGHCVE<br>LINQKVPQSVTNSVPKPVSKKHGKLITFLRTFMKSRPTKQKLKQRG<br>ILKERVFGCDLGEHLLNSGFEVPQVLQSCTAFIERYGIVDGIYRLSG<br>VASNIQRLRHEFDSEHVPDLTKEPYVQDIHSVGSLCKLYFRELPNPL<br>LTYQLYEKFSDAVSAATDEERLIKIHDVIQQLPPPHYRTLEFLMRHL<br>SLLADYCSITNMHAKNLAIVWAPNLLRSKQIESACFSGTAAFMEVR<br>IQSVVVEFILNHVDVLFSGRISMAMQEGAASLSRPKSLLVSSPSTKL<br>LTLEEAQARTQAQVNSPIVTENKYIEVGEGPAALQGKFHTIIEFPLE<br>RKRPQNKMKKSPVGSWRSFFNLGKSSSVSKRKLQRNESEPSEMKA<br>MALKGGRAEGTLRSAKSEESLTSLHAVDGDSKLFRPRRPRSSSDAL<br>SASFNGEMLGNRCNSYDNLPHDNESEEEGGLLHIPALMSPHSAED<br>VDLSPPDIGVASLDFDPMSFQCSPPKAESECLESGASFLDSPGYSKD<br>KPSANKKDAETGSSQCQTPGSTASSEPVSPLQEKLSPFFTLDLSPTE<br>DKSSKPSSFTEKVVYAFSPKIGRKLSKSPSMSISEPISVTLPPRVSEVI<br>GTVSNTTAQNASSSTWDKCVEERDATNRSPTQIVKMKTNETVAQE<br>AYESEVQPLDQVAAEEVELPGKEDQSVSSSQSKAVASGQTQTGAV<br>THDPPQDSVPVSSVSLIPPPPPPKNVARMLALALAESAQQASTQSL<br>KRPGTSQAGYTNYGDIAVATTEDNLSSSYSAVALDKAYFQTDRPA<br>EQFHLQNNAPGNCDHPLPETTATGDPTHSNTTESGEQHHQVDLTG<br>NQPHQAYLSGDPEKARITSVPLDSEKSDDHVSFPEDQSGKNSMPTV<br>SFLDQDQSPPRFYSGDQPPSYLGASVDKLHHPLEFADKSPTPPNLPS<br>DKIYPPSGSPEENTSTATMTYMTTTPATAQMSTKEASWDVAEQPT<br>TADFAAATLQRTHRTNRPLPPPPSQRSAEQPPVVGQVQAATNIGLN<br>NSHKVQGVVPVPERPPEPRAMDDPASAFISDSGAAAAQCPMATAV<br>QPGLPEKVRDGARVPLLHLRAESVPAHPCGFPAPLPPTRMMESKM<br>IAAIHSSSADATSSSNYHSFVTASSTSVDDALPLPLPVPQPKHASQK<br>TVYSSFARPDVTTEPFGPDNCLHFNMTPNCQYRPQSVPPHHNKLE<br>QHQVYGARSEPPASMGLRYNTYVAPGRNASGHHSKPCSRVEYVS<br>SLSSSVRNTCYPEDIPPYPTIRRVQSLHAPPSSMIRSVPISRTEVPPDD<br>EPAYCPRPLYQYKPYQSSQARSDYHVTQLQPYFENGRVHYRYSPY<br>SSSSSSYYSPDGALCDVDAYGTVQLRPLHRLPNRDFAFYNPRLQG<br>KSLYSYAGLAPRPRANVTGYFSPNDHNVVSMPPAADVKHTYTSW<br>DLEDMEKYRMQSIRRESRARQKVKGPVMSQYDNMTPAVQDDLG<br>GIYVIHLRSKSDPGKTGLLSVAEGKESRHAAKAISPEGEDRFYRRH<br>PEAEMDRAHHHGGHGSTQPEKPSLPQKQSSLRSRKLPDMGCSLPE<br>HRAHQEASHRQFCESKNGPPYPQGAGQLDYGSKGIPDTSEPVSYH<br>NSGVKYAASGQESLRLNHKEVRLSKEMERPWVRQPSAPEKHSRD<br>CYKEEEHLTQSIVPPPKPERSHSLKLHHTQNVERDPSVLYQYQPHG<br>KRQSSVTVVSQYDNLEDYHSLPQHQRGVFGGGGMGTYVPPGFPH<br>PQSRTYATALGQGAFLPAELSLQHPETQIHAE |

As used herein the terms "sequence identity" or "sequence homology," which can be used interchangeably, refer to an exact amino acid-to-amino acid correspondence of two polypeptide sequences. Typically, techniques for determining sequence identity include determining the amino acid sequence of a polypeptide, and comparing these sequences to a second amino acid sequence. Two or more sequences can be compared by determining their "percent identity," also referred to as "percent homology." The percent identity to a reference sequence, which may be a sequence within a longer molecule, may be calculated as the number of exact matches between two optimally aligned sequences divided by the length of the reference sequence and multiplied by 100. Percent identity may also be determined, for example, by comparing sequence information using the advanced BLAST computer program, including version 2.2.9, available from the National Institutes of Health. The BLAST program is based on the alignment method of Karlin and Altschul, Proc. Natl. Acad. Sci. USA 87:2264-2268 (1990) and as discussed in Altschul, et al., J. Mol. Biol. 215:403-410 (1990); Karlin and Altschul, Proc. Natl. Acad. Sci. USA 90:5873-5877 (1993); and Altschul et al., Nucleic Acids Res. 25:3389-3402 (1997). Briefly, the BLAST program defines identity as the number of identical aligned symbols (i.e., nucleotides or amino acids), divided by the total number of symbols in the shorter of the two sequences. The program may be used to determine percent identity over the entire length of the sequences being compared. Default parameters are provided to optimize searches with short query sequences, for example, with the blastp program. The program also allows use of an SEG filter to mask-off segments of the query sequences as determined by the SEG program of Wootton and Federhen, Computers and Chemistry 17: 149-163 (1993). Ranges of desired degrees of sequence identity are approximately 80% to 100% and integer values in between. Percent identities between a disclosed sequence and a claimed sequence can be at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity. In general, an exact match indicates 100% identity over the length of the reference sequence. In some cases, reference to percent sequence identity refers to sequence identity as measured using BLAST (Basic Local Alignment Search Tool). In other cases, ClustalW can be used for multiple sequence alignment. Still other programs for comparing sequences and/or assessing sequence identity include the Needleman-Wunsch algorithm and the Smith-Waterman algorithm (see, e.g., the EMBOSS Water aligner. Optimal alignment may be assessed using any suitable parameters of a chosen algorithm, including default parameters.

In one aspect, the sequence identity is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% (complete) sequence identity (homology). In one aspect, the sequence identity is over a region of at least about 10, 50, 100, 150, 200, 250, 300, 350, 400, 450, 500, 550, 600, 650, 700, 750, 800, 850, 900, 950, 1000, 1100.1200, 1300, 1400, 1500, 1600, 1700, 1800, 1900, 2000, 2100, 2200, 2300, 2400, 2500, 2600, 2700, 2800, 2900, 3000 or more amino acids, or the full length of a polypeptide.

As used herein, the term "fragment" refers at least 10 consecutive amino acids of a polypeptide that can be detected using methods known in the art. Fragment may refer to an "active" fragment which is a portion of the polypeptide required for polypeptide function. The fragment can be an "immunogenic" fragment which is a portion of the polypeptide which binds an antibody.

As used herein, a "sample" or "biological sample" is meant to refer to any "biological specimen" collected from a subject, and that is representative of the content or composition of the source of the sample, considered in its entirety. A sample can be collected and processed directly for analysis, or be stored under proper storage conditions to maintain sample quality until analyses are completed. Ideally, a stored sample remains equivalent to a freshly-collected specimen. The source of the sample can be an internal organ, vein, artery, or even a fluid. Non-limiting examples of sample include blood, plasma, urine, saliva, sweat, organ biopsy, cerebrospinal fluid (CSF), tear, vaginal fluid, feces, skin, and hair. In one aspect, the sample is selected from the group consisting of blood, plasma, urine, saliva, sweat, organ biopsy, cerebrospinal fluid (CSF), tear, vaginal fluid, feces, skin, and hair. In certain aspects the sample is a blood sample and the subject is human. Blood samples include whole blood, plasma and serum.

The at least one protein refers to one or more proteins. In an aspect, the at least one polypeptide comprises 1, 2, 3, 4, 5, 6, 7, 8, 9, 10, 11, 12, 13, 14, 15, 16, 17, 18, 19, 20 or more proteins. In one aspect the at least one protein is selected from the group consisting of Farnesyl pyrophosphate synthase, neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, Heat Shock Protein Cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof. In another aspect, the at least one protein is selected from the group consisting of SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71, SEQ ID NO:72, SEQ ID NO:73, SEQ ID NO:74, SEQ ID NO:75, SEQ ID NO:76, SEQ ID NO:77, SEQ ID NO:78, SEQ ID NO:79, SEQ ID NO:80, SEQ ID NO:81, SEQ ID NO:82, SEQ ID NO:83, SEQ ID NO:84, SEQ ID NO:85, SEQ ID NO:86, SEQ ID NO:87, SEQ ID NO:88, SEQ ID NO:89, SEQ ID NO:90, SEQ ID NO:91, SEQ ID NO:92, SEQ ID NO:93, SEQ ID NO:94, SEQ ID NO:95, SEQ ID NO:96, SEQ ID NO:97, SEQ ID NO:98, SEQ ID NO:99, SEQ ID NO:100, SEQ ID NO:101, SEQ ID NO:102, SEQ ID NO:103, SEQ ID NO:104, SEQ ID NO:105, SEQ ID NO:106, SEQ ID NO:107, SEQ ID NO:108, SEQ ID NO:109, SEQ ID NO:110, SEQ ID NO:111, SEQ ID NO:112, SEQ ID NO:113, SEQ ID NO:114, SEQ ID NO:115, SEQ ID NO:116, SEQ ID NO:117, SEQ ID NO:118, SEQ ID NO:119, SEQ ID NO:120, SEQ ID NO:121, SEQ ID NO:122, SEQ ID NO:123, SEQ ID NO:124, SEQ ID NO:125, SEQ ID NO:126, SEQ ID NO:127, SEQ ID NO:128, SEQ ID NO:129, SEQ ID NO:130, SEQ ID NO:131, SEQ ID NO:132, SEQ ID NO:133, SEQ ID NO:134, SEQ ID NO:135, SEQ ID NO:136, SEQ ID NO:137, SEQ ID NO:138, SEQ ID NO:139, SEQ ID NO:140, SEQ ID NO:141, SEQ ID NO:142, SEQ ID NO:143, SEQ ID NO:144, SEQ ID NO:145, SEQ ID NO:146, SEQ ID NO:147 or a fragment thereof.

In one aspect the at least one protein is selected from the group consisting of Farnesyl pyrophosphate synthase, neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, Heat Shock Protein Cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a combination thereof. In another aspect, the at least one protein is selected from the group consisting of SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71, SEQ ID NO:72, SEQ ID NO:73, SEQ ID NO:74, SEQ ID NO:75, SEQ ID NO:76, SEQ ID NO:77, SEQ ID NO:78, SEQ ID NO:79, SEQ ID NO:80, SEQ ID NO:81, SEQ ID NO:82, SEQ ID NO:83, SEQ ID NO:84, SEQ ID NO:85, SEQ ID NO:86, SEQ ID NO:87, SEQ ID NO:88, SEQ ID NO:89, SEQ ID NO:90, SEQ ID NO:91, SEQ ID NO:92, SEQ ID NO:93, SEQ ID NO:94, SEQ ID NO:95, SEQ ID NO:96, SEQ ID NO:97, SEQ ID NO:98, SEQ ID NO:99, SEQ ID NO:100, SEQ ID NO:101, SEQ ID NO:102, SEQ ID NO:103, SEQ ID NO:104, SEQ ID NO:105, SEQ ID NO:106, SEQ ID NO:107, SEQ ID NO:108, SEQ ID NO:109, SEQ ID NO:110, SEQ ID NO:111, SEQ ID NO:112, SEQ ID NO:113, SEQ ID NO:114, SEQ ID NO:115, SEQ ID NO:116, SEQ ID NO:117, SEQ ID NO:118, SEQ ID NO:119, SEQ ID NO:120, SEQ ID NO:121, SEQ ID NO:122, SEQ ID NO:123, SEQ ID NO:124, SEQ ID NO:125, SEQ ID NO:126, SEQ ID NO:127, SEQ ID NO:128, SEQ ID NO:129, SEQ ID NO:130, SEQ ID NO:131, SEQ ID NO:132, SEQ ID NO:133, SEQ ID NO:134, SEQ ID NO:135, SEQ ID NO:136, SEQ ID NO:137, SEQ ID NO:138, SEQ ID NO:139, SEQ ID NO:140, SEQ ID NO:141, SEQ ID NO:142, SEQ ID NO:143, SEQ ID NO:144, SEQ ID NO:145, SEQ ID NO:146, SEQ ID NO:147 or a combination thereof.

The biomarkers of the present invention may be used individually or in combinations for the diagnosis of cervical cancer. Any combination of the biomarkers listed above and in Table 1 can be used for the diagnosis of cervical cancers.

In another aspect, the at least one polypeptide comprises Farnesyl pyrophosphate synthase or fragment thereof and at least one polypeptide selected from neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, Heat shock protein cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof. In an additional aspect, the at least one polypeptide comprises a polypeptide having at least about 70% sequence identity to a polypeptide having the amino acid sequence of SEQ ID NO:1 and at least one polypeptide selected from a polypeptide with at least about 70% sequence identity to a polypeptide having the amino acid sequence selected from SEQ ID NOs:2-20 or a fragment thereof.

In one aspect, the at least one polypeptide comprises Farnesyl pyrophosphate synthase and neurofibromin I; Farnesyl pyrophosphate synthase and Glyceraldehyde-3 phosphate dehydrogenase; Farnesyl pyrophosphate synthase and Protein 1 containing fibronectin domain type III; Farnesyl pyrophosphate synthase and Eukaryotic initiation factor 4A-I; Farnesyl pyrophosphate synthase and L-lactate dehydrogenase chain B; Farnesyl pyrophosphate synthase and Nuclear heterogeneous Ribonucleoprotein A1; Farnesyl pyrophosphate synthase and polycystic kidney disease protein 1-like 1; Farnesyl pyrophosphate synthase and heat shock protein Cognate 71 kDa; Farnesyl pyrophosphate synthase and Ankyrin-3; Farnesyl pyrophosphate synthase and Rho 23; Farnesyl pyrophosphate synthase and Rho 23-GTPase-activating protein; Farnesyl pyrophosphate synthase and Cytoskeletal Keratin 78 type II; Farnesyl pyrophosphate synthase and collagen chain (VI) Alpha-3; Farnesyl pyrophosphate synthase and Beta subunit of proteasome type-5; Farnesyl pyrophosphate synthase and Heterogeneous nuclear ribonucleoproteins A2/B1; Farnesyl pyrophosphate synthase and Histone H2B type 1-B; Farnesyl pyrophosphate synthase and homolog of DnaJ subfamily C member 13; Farnesyl pyrophosphate synthase and Beta enolase; Farnesyl pyrophosphate synthase and Glutathione S-transferase P; Farnesyl pyrophosphate synthase and Glutathione S-transferase Mu 3; or fragments thereof.

In another aspect, the at least one polypeptide comprises SEQ ID NO:1 and SEQ ID NO:2; SEQ ID NO:1 and SEQ ID NO:3; SEQ ID NO:1 and SEQ ID NO:4; SEQ ID NO:1 and SEQ ID NO:5; SEQ ID NO:1 and SEQ ID NO:6; SEQ ID NO:1 and SEQ ID NO:7; SEQ ID NO:1 and SEQ ID NO:8; SEQ ID NO:1 and SEQ ID NO:9; SEQ ID NO:1 and SEQ ID NO:10; SEQ ID NO:1 and SEQ ID NO:11; SEQ ID NO:1 and SEQ ID NO:12; SEQ ID NO:1 and SEQ ID NO:13; SEQ ID NO:1 and SEQ ID NO:14; SEQ ID NO:1 and SEQ ID NO:15; SEQ ID NO:1 and SEQ ID NO:16; SEQ ID NO:1 and SEQ ID NO:17; SEQ ID NO:1 and SEQ ID NO:18; SEQ ID NO:1 and SEQ ID NO:19; SEQ ID NO:1 and SEQ ID NO:20; or fragments thereof.

In one aspect, the at least one polypeptide comprises Farnesyl pyrophosphate synthase or a fragment thereof, neurofibromin or a fragment thereof, and at least one additional polypeptide selected from the group consisting of Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, Heat Shock Protein Cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 and a fragment thereof.

In another aspect, the at least one polypeptide comprises Farnesyl pyrophosphate synthase or a fragment thereof, Glyceraldehyde-3 phosphate dehydrogenase or a fragment thereof, and at least one additional polypeptide selected from the group consisting of neurofibromin, Protein 1 containing fibronectin domain type III, Eukaryotic initiation factor 4A-I, L-lactate dehydrogenase chain B, Nuclear heterogeneous Ribonucleoprotein A1, polycystic kidney disease protein 1-like 1, heat shock protein Cognate 71 kDa, Ankyrin-3, Rho 23 GTPase-activating protein, Cytoskeletal Keratin 78 type II, collagen chain (VI) Alpha-3, Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 and a fragment thereof.

In one aspect, the at least one polypeptide comprises Farnesyl pyrophosphate synthase or a fragment thereof, Protein 1 containing fibronectin domain type III or a fragment thereof, and at least one additional polypeptide selected from the group consisting of neurofibromin, Glyceraldehyde-3 phosphate dehydrogenase, Eukaryotic initiation factor 4A-I, L-lactate dehydrogenase chain B, Nuclear heterogeneous Ribonucleoprotein A1, polycystic kidney disease protein 1-like 1, heat shock protein Cognate 71 kDa, Ankyrin-3, Rho 23 GTPase-activating protein, Cytoskeletal Keratin 78 type II, collagen chain (VI) Alpha-3, Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 and a fragment thereof.

In another aspect, the at least one polypeptide comprises Farnesyl pyrophosphate synthase or a fragment thereof, Eukaryotic initiation factor 4A-I or a fragment thereof, and at least one additional polypeptide selected from the group consisting of neurofibromin, Glyceraldehyde-3 phosphate dehydrogenase, Protein 1 containing fibronectin domain type III, L-lactate dehydrogenase chain B, Nuclear heterogeneous Ribonucleoprotein A1, polycystic kidney disease protein 1-like 1, heat shock protein Cognate 71 kDa, Ankyrin-3, Rho 23 GTPase-activating protein, Cytoskeletal Keratin 78 type II, collagen chain (VI) Alpha-3, Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, and Glutathione S-transferase Mu 3 and a fragment thereof.

In one aspect, the at least one polypeptide comprises Farnesyl pyrophosphate synthase or a fragment thereof, L-lactate dehydrogenase chain B or a fragment thereof, and at least one additional polypeptide selected from the group consisting of neurofibromin, Glyceraldehyde-3 phosphate dehydrogenase, Protein 1 containing fibronectin domain type III, Eukaryotic initiation factor 4A-I, Nuclear heterogeneous Ribonucleoprotein A1, polycystic kidney disease protein 1-like 1, heat shock protein Cognate 71 kDa, Ankyrin-3, Rho 23 GTPase-activating protein, Cytoskeletal Keratin 78 type II, collagen chain (VI) Alpha-3, Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 and a fragment thereof.

In another aspect, the at least one polypeptide comprises Farnesyl pyrophosphate synthase or a fragment thereof, Nuclear heterogeneous Ribonucleoprotein A1 or a fragment thereof, and at least one additional polypeptide selected from the group consisting of neurofibromin, Glyceraldehyde-3 phosphate dehydrogenase, Protein 1 containing fibronectin domain type III, Eukaryotic initiation factor 4A-I, L-lactate dehydrogenase chain B, polycystic kidney disease protein 1-like 1, heat shock protein Cognate 71 kDa, Ankyrin-3, Rho 23 GTPase-activating protein, Cytoskeletal Keratin 78 type II, collagen chain (VI) Alpha-3, Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 and a fragment thereof.

In one aspect, the at least one polypeptide comprises Farnesyl pyrophosphate synthase or a fragment thereof, polycystic kidney disease protein 1-like 1 or a fragment thereof, and at least one additional polypeptide selected from the group consisting of neurofibromin, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, heat shock protein Cognate 71 kDa, Ankyrin-3, Rho 23 GTPase-activating protein, Cytoskeletal Keratin 78 type II, collagen chain (VI) Alpha-3, Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 and a fragment thereof.

In another aspect, the at least one polypeptide comprises Farnesyl pyrophosphate synthase or a fragment thereof, heat shock protein Cognate 71 kDa or a fragment thereof, and at least one additional polypeptide selected from the group consisting of neurofibromin, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, polycystic kidney disease protein 1-like 1, Ankyrin-3, Rho 23 GTPase-activating protein, Cytoskeletal Keratin 78 type II, collagen chain (VI) Alpha-3, Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 and a fragment thereof.

In one aspect, the at least one polypeptide comprises Farnesyl pyrophosphate synthase or a fragment thereof, Ankyrin-3 or a fragment thereof, and at least one additional polypeptide selected from the group consisting of neurofibromin, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, polycystic kidney disease protein 1-like 1, heat shock protein Cognate 71 kDa, Rho 23 GTPase-activating protein, Cytoskeletal Keratin 78 type II, collagen chain (VI) Alpha-3, Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 and a fragment thereof.

In another aspect, the at least one polypeptide comprises Farnesyl pyrophosphate synthase or a fragment thereof, Rho 23 GTPase-activating protein or a fragment thereof, and at least one additional polypeptide selected from the group consisting of neurofibromin, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, polycystic kidney disease protein 1-like 1, heat shock protein Cognate 71 kDa, Ankyrin-3, Cytoskeletal Keratin 78 type II, collagen chain (VI) Alpha-3, Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 and a fragment thereof.

In one aspect, the at least one polypeptide comprises Farnesyl pyrophosphate synthase or a fragment thereof, Cytoskeletal Keratin 78 type II or a fragment thereof, and at least one additional polypeptide selected from the group consisting of neurofibromin, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, polycystic kidney disease protein 1-like 1, heat shock protein Cognate 71 kDa, Ankyrin-3, Rho 23 GTPase-activating protein, collagen chain (VI) Alpha-3, Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 and a fragment thereof.

In another aspect, the at least one polypeptide comprises Farnesyl pyrophosphate synthase or a fragment thereof, collagen chain (VI) Alpha-3 or a fragment thereof, and at least one additional polypeptide selected from the group consisting of neurofibromin, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, polycystic kidney disease protein 1-like 1, heat shock protein Cognate 71 kDa, Ankyrin-3, Rho 23 GTPase-activating protein, Cytoskeletal Keratin 78 type II, Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 and a fragment thereof.

In one aspect, the at least one polypeptide comprises Farnesyl pyrophosphate synthase or a fragment thereof, Beta subunit of proteasome type-5 or a fragment thereof, and at least one additional polypeptide selected from the group consisting of neurofibromin, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, polycystic kidney disease protein 1-like 1, heat shock protein Cognate 71 kDa, Ankyrin-3, Rho 23 GTPase-activating protein, Cytoskeletal Keratin 78 type II, collagen chain (VI) Alpha-3, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 and a fragment thereof.

In another aspect, the at least one polypeptide comprises Farnesyl pyrophosphate synthase or a fragment thereof, Heterogeneous nuclear ribonucleoproteins A2/B1 or a fragment thereof, and at least one additional polypeptide selected from the group consisting of neurofibromin, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, polycystic kidney disease protein 1-like 1, heat shock protein Cognate 71 kDa, Ankyrin-3, Rho 23 GTPase-activating protein, Cytoskeletal Keratin 78 type II, collagen chain (VI) Alpha-3, Beta subunit of proteasome type-5, Histone H2B type 1-B, homolog of DnaJ subfamily C member 13, Beta enolase, Glutathione S-transferase P, Glutathione S-transferase Mu 3 and a fragment thereof.

In one aspect, the at least one polypeptide comprises Farnesyl pyrophosphate synthase or a fragment thereof, Histone H2B type 1-B or a fragment thereof, and at least one additional polypeptide selected from the group consisting of neurofibromin, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, polycystic kidney disease protein 1-like 1, heat shock protein Cognate 71 kDa, Ankyrin-3, Rho 23 GTPase-activating protein, Cytoskeletal Keratin 78 type II, collagen chain (VI) Alpha-3, Beta subunit of proteasome type-5, Heterogeneous nuclear ribonucleoproteins A2/B1, homolog of DnaJ family C member 13, Beta enolase, Glutathione S-transferase P, Glutathione S-transferase Mu 3 and a fragment thereof.

In another aspect, the at least one polypeptide comprises Farnesyl pyrophosphate synthase or a fragment thereof, homolog of DnaJ subfamily C member 13 or a fragment thereof, and at least one additional polypeptide selected from the group consisting of neurofibromin, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, polycystic kidney disease protein 1-like 1, heat shock protein Cognate 71 kDa, Ankyrin-3, Rho 23 GTPase-activating protein, Cytoskeletal Keratin 78 type II, collagen chain (VI) Alpha-3, Beta subunit of proteasome type-5, Heterogeneous nuclear ribonucleoproteins A2/B1, Histone H2B type 1-B, Beta enolase, Glutathione S-transferase P, Glutathione S-transferase Mu 3 and a fragment thereof.

In one aspect, the at least one polypeptide comprises Farnesyl pyrophosphate synthase or a fragment thereof, Beta enolase or a fragment thereof, and at least one additional polypeptide selected from the group consisting of neurofibromin, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, polycystic kidney disease protein 1-like 1, heat shock protein Cognate 71 kDa, Ankyrin-3, Rho 23 GTPase-activating protein, Cytoskeletal Keratin 78 type II, collagen chain (VI) Alpha-3, Beta subunit of proteasome type-5, Heterogeneous nuclear ribonucleoproteins A2/B1, Histone H2B type 1-B, homolog of DnaJ subfamily C member 13, Glutathione S-transferase P, Glutathione S-transferase Mu 3 and a fragment thereof.

In another aspect, the at least one polypeptide comprises Farnesyl pyrophosphate synthase or a fragment thereof, Glutathione S-transferase P or a fragment thereof, and at least one additional polypeptide selected from the group consisting of neurofibromin, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, polycystic kidney disease protein 1-like 1, heat shock protein Cognate 71 kDa, Ankyrin-3, Rho 23 GTPase-activating protein, Cytoskeletal Keratin 78 type II, collagen chain (VI) Alpha-3, Beta subunit of proteasome type-5, Heterogeneous nuclear ribonucleoproteins A2/B1, Histone H2B type 1-B, homolog of DnaJ subfamily C member 13, Beta enolase, Glutathione S-transferase Mu 3 and a fragment thereof.

In one aspect, the at least one polypeptide comprises Farnesyl pyrophosphate synthase or a fragment thereof, Glutathione S-transferase Mu 3 or a fragment thereof, and at least one additional polypeptide selected from the group consisting of neurofibromin, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, polycystic kidney disease protein 1-like 1, heat shock protein Cognate 71 kDa, Ankyrin-3, Rho 23 GTPase-activating protein, Cytoskeletal Keratin 78 type II, collagen chain (VI) Alpha-3, Beta subunit of proteasome type-5, Heterogeneous nuclear ribonucleoproteins A2/B1, Histone H2B type 1-B, homolog of DnaJ subfamily C member 13, Beta enolase, Glutathione S-transferase P and a fragment thereof.

In one aspect, the at least one polypeptide comprises a polypeptide with at least about 70% sequence identity to a polypeptide having the amino acid sequence of SEQ ID NO:1 or a fragment thereof, and a polypeptide with at least about 70% sequence identity to a polypeptide having the amino acid sequence of SEQ ID NO:2 or a fragment thereof, and at least one additional polypeptide having at least about 70% sequence identity to a polypeptide having an amino acid sequence selected from the group consisting of SEQ ID NOs:3-20 and a fragment thereof.

In another aspect, the at least one polypeptide comprises a polypeptide with at least about 70% sequence identity to a polypeptide having the amino acid sequence of SEQ ID NO:1 or a fragment thereof, and a polypeptide with at least about 70% sequence identity to a polypeptide having the amino acid sequence of SEQ ID NO:3 or a fragment thereof, and at least one additional polypeptide having at least about 70% sequence identity to a polypeptide an amino acid sequence selected from the group consisting of SEQ ID NOs:2 and 4-20 and a fragment thereof.

In one aspect, the at least one polypeptide comprises a polypeptide with at least about 70% sequence identity to a polypeptide having the amino acid sequence of SEQ ID NO:1 or a fragment thereof, and a polypeptide with at least about 70% sequence identity to a polypeptide having the amino acid sequence of SEQ ID NO:4 or a fragment thereof, and at least one additional polypeptide having at least about 70% sequence identity to a polypeptide an amino acid sequence selected from the group consisting of SEQ ID NOs:2-3 and 5-20 and a fragment thereof.

In another aspect, the at least one polypeptide comprises a polypeptide with at least about 70% sequence identity to a polypeptide having the amino acid sequence of SEQ ID NO:1 or a fragment thereof, and a polypeptide with at least about 70% sequence identity to a polypeptide having the amino acid sequence of SEQ ID NO:5 or a fragment thereof, and at least one additional polypeptide having at least about 70% sequence identity to a polypeptide an amino acid sequence selected from the group consisting of SEQ ID NOs:2-4 and 6-20 and a fragment thereof.

In one aspect, the at least one polypeptide comprises a polypeptide with at least about 70% sequence identity to a polypeptide having the amino acid sequence of SEQ ID NO:1 or a fragment thereof, and a polypeptide with at least about 70% sequence identity to a polypeptide having the amino acid sequence of SEQ ID NO:6 or a fragment thereof, and at least one additional polypeptide having at least about 70% sequence identity to a polypeptide an amino acid sequence selected from the group consisting of SEQ ID NOs:2-5 and 7-20 and a fragment thereof.

In another aspect, the at least one polypeptide comprises a polypeptide with at least about 70% sequence identity to a polypeptide having the amino acid sequence of SEQ ID NO:1 or a fragment thereof, and a polypeptide with at least about 70% sequence identity to a polypeptide having the amino acid sequence of SEQ ID NO:7 or a fragment thereof, and at least one additional polypeptide having at least about 70% sequence identity to a polypeptide an amino acid sequence selected from the group consisting of SEQ ID NOs:2-6 and 8-20 and a fragment thereof.

In one aspect, the at least one polypeptide comprises a polypeptide with at least about 70% sequence identity to a polypeptide having the amino acid sequence of SEQ ID NO:1 or a fragment thereof, and a polypeptide with at least about 70% sequence identity to a polypeptide having the amino acid sequence of SEQ ID NO:8 or a fragment thereof, and at least one additional polypeptide having at least about 70% sequence identity to a polypeptide an amino acid sequence selected from the group consisting of SEQ ID NOs:2-7 and 9-20 and a fragment thereof.

In another aspect, the at least one polypeptide comprises a polypeptide with at least about 70% sequence identity to a polypeptide having the amino acid sequence of SEQ ID NO:1 or a fragment thereof, and a polypeptide with at least about 70% sequence identity to a polypeptide having the amino acid sequence of SEQ ID NO:9 or a fragment thereof, and at least one additional polypeptide having at least about 70% sequence identity to a polypeptide an amino acid sequence selected from the group consisting of SEQ ID NOs:2-8 and 10-20 and a fragment thereof.

In one aspect, the at least one polypeptide comprises a polypeptide with at least about 70% sequence identity to a polypeptide having the amino acid sequence of SEQ ID NO:1 or a fragment thereof, and a polypeptide with at least about 70% sequence identity to a polypeptide having the amino acid sequence of SEQ ID NO:10 or a fragment thereof, and at least one additional polypeptide having at least about 70% sequence identity to a polypeptide an amino acid sequence selected from the group consisting of SEQ ID NOs:2-9 and 11-20 and a fragment thereof.

In another aspect, the at least one polypeptide comprises a polypeptide with at least about 70% sequence identity to a polypeptide having the amino acid sequence of SEQ ID NO:1 or a fragment thereof, and a polypeptide with at least about 70% sequence identity to a polypeptide having the amino acid sequence of SEQ ID NO:11 or a fragment thereof, and at least one additional polypeptide having at least about 70% sequence identity to a polypeptide an amino acid sequence selected from the group consisting of SEQ ID NOs:2-10 and 12-20 and a fragment thereof.

In one aspect, the at least one polypeptide comprises a polypeptide with at least about 70% sequence identity to a polypeptide having the amino acid sequence of SEQ ID NO:1 or a fragment thereof, and a polypeptide with at least about 70% sequence identity to a polypeptide having the amino acid sequence of SEQ ID NO:12 or a fragment thereof, and at least one additional polypeptide having at least about 70% sequence identity to a polypeptide an amino acid sequence selected from the group consisting of SEQ ID NOs:2-11 and 13-20 and a fragment thereof.

In another aspect, the at least one polypeptide comprises a polypeptide with at least about 70% sequence identity to a polypeptide having the amino acid sequence of SEQ ID NO:1 or a fragment thereof, and a polypeptide with at least about 70% sequence identity to a polypeptide having the amino acid sequence of SEQ ID NO:13 or a fragment thereof, and at least one additional polypeptide having at least about 70% sequence identity to a polypeptide an amino acid sequence selected from the group consisting of SEQ ID NOs:2-12 and 14-20 and a fragment thereof.

In one aspect, the at least one polypeptide comprises a polypeptide with at least about 70% sequence identity to a polypeptide having the amino acid sequence of SEQ ID NO:1 or a fragment thereof, and a polypeptide with at least about 70% sequence identity to a polypeptide having the amino acid sequence of SEQ ID NO:14 or a fragment thereof, and at least one additional polypeptide having at least about 70% sequence identity to a polypeptide an amino acid sequence selected from the group consisting of SEQ ID NOs:2-13 and 15-20 and a fragment thereof.

In another aspect, the at least one polypeptide comprises a polypeptide with at least about 70% sequence identity to a polypeptide having the amino acid sequence of SEQ ID NO:1 or a fragment thereof, and a polypeptide with at least about 70% sequence identity to a polypeptide having the amino acid sequence of SEQ ID NO:15 or a fragment thereof, and at least one additional polypeptide having at least about 70% sequence identity to a polypeptide an amino acid sequence selected from the group consisting of SEQ ID NOs:2-14 and 16-20 and a fragment thereof.

In one aspect, the at least one polypeptide comprises a polypeptide with at least about 70% sequence identity to a polypeptide having the amino acid sequence of SEQ ID NO:1 or a fragment thereof, and a polypeptide with at least about 70% sequence identity to a polypeptide having the amino acid sequence of SEQ ID NO:16 or a fragment thereof, and at least one additional polypeptide having at least about 70% sequence identity to a polypeptide an amino acid sequence selected from the group consisting of SEQ ID NOs:2-15 and 17-20 and a fragment thereof.

In another aspect, the at least one polypeptide comprises a polypeptide with at least about 70% sequence identity to a polypeptide having the amino acid sequence of SEQ ID NO:1 or a fragment thereof, and a polypeptide with at least about 70% sequence identity to a polypeptide having the amino acid sequence of SEQ ID NO:17 or a fragment thereof, and at least one additional polypeptide having at least about 70% sequence identity to a polypeptide an amino acid sequence selected from the group consisting of SEQ ID NOs:2-16 and 18-20 and a fragment thereof.

In one aspect, the at least one polypeptide comprises a polypeptide with at least about 70% sequence identity to a polypeptide having the amino acid sequence of SEQ ID NO:1 or a fragment thereof, and a polypeptide with at least about 70% sequence identity to a polypeptide having the amino acid sequence of SEQ ID NO:18 or a fragment thereof, and at least one additional polypeptide having at least about 70% sequence identity to a polypeptide an amino acid sequence selected from the group consisting of SEQ ID NOs:2-17 and 19-20 and a fragment thereof.

In another aspect, the at least one polypeptide comprises a polypeptide with at least about 70% sequence identity to a polypeptide having the amino acid sequence of SEQ ID NO:1 or a fragment thereof, and a polypeptide with at least about 70% sequence identity to a polypeptide having the amino acid sequence of SEQ ID NO:19 or a fragment thereof, and at least one additional polypeptide having at least about 70% sequence identity to a polypeptide an amino acid sequence selected from the group consisting of SEQ ID NOs:2-18 and 20 and a fragment thereof.

In one aspect, the at least one polypeptide comprises a polypeptide with at least about 70% sequence identity to a polypeptide having the amino acid sequence of SEQ ID NO:1 or a fragment thereof, and a polypeptide with at least about 70% sequence identity to a polypeptide having the amino acid sequence of SEQ ID NO:20 or a fragment thereof, and at least one additional polypeptide having at least about 70% sequence identity to a polypeptide an amino acid sequence selected from the group consisting of SEQ ID NOs:2-19 and a fragment thereof.

In a further aspect, the detecting is by protein microarray, fluorescence detection, flow cytometry, microfluidic device, lateral flow assay, vertical flow assay or immunoassay. In a specific aspect, the detecting is by lateral flow.

In one aspect, the method also includes administering a treatment to the subject. In an additional aspect, the treatment is surgery, radiation, chemotherapy, targeted therapy and/or immunotherapy.

The term "treatment" is used interchangeably herein with the term "therapeutic method" and refers to both 1) therapeutic treatments or measures that cure, slow down, lessen symptoms of, and/or halt progression of a diagnosed pathologic conditions or disorder, and 2) and prophylactic/preventative measures. Those in need of treatment may include individuals already having a particular medical disorder as well as those who may ultimately acquire the disorder (i.e., those needing preventive measures).

The terms "therapeutically effective amount", "effective dose," "therapeutically effective dose", "effective amount," or the like refer to that amount of the subject compound that will elicit the biological or medical response of a tissue, system, animal or human that is being sought by the researcher, veterinarian, medical doctor or other clinician.

The terms "administration of" and or "administering" should be understood to mean providing a pharmaceutical composition in a therapeutically effective amount to the subject in need of treatment. Administration routes can be enteral, topical or parenteral. As such, administration routes include but are not limited to intracutaneous, subcutaneous, intravenous, intraperitoneal, intraarterial, intrathecal, intracapsular, intraorbital, intracardiac, intradermal, transdermal, transtracheal, subcuticular, intraarticulare, subcapsular, subarachnoid, intraspinal and intrasternal, oral, sublingual buccal, rectal, vaginal, nasal ocular administrations, as well infusion, inhalation, and nebulization. The phrases "parenteral administration" and "administered parenterally" as used herein means modes of administration other than enteral and topical administration. The pharmaceutical compositions can be administered in a variety of unit dosage forms depending upon the method of administration. Suitable unit dosage forms, include, but are not limited to powders, tablets, pills, capsules, lozenges, suppositories, patches, nasal sprays, injectables, implantable sustained-release formulations, lipid complexes, etc.

The biomarkers and polypeptides disclosed herein are useful for the diagnosis of cervical cancer. As used herein, the term "diagnosis" refers to any method of detecting or determining that a subject has cervical cancer.

In another embodiment, the present invention provides a method of diagnosing cervical cancer in a subject by detecting at least one polypeptide in a sample from a subject; wherein the at least one polypeptide is selected from Farnesyl pyrophosphate synthase, neurofibromin 1, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, Heat shock protein cognate protein 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof, or a polypeptide with at least about 70% sequence identity to a polypeptide having the amino acid sequence to a polypeptide having the amino acid sequence selected from SEQ ID NOs: 1-147 or a fragment thereof, and diagnosing cervical cancer based on the detection of at least one polypeptide. In one aspect, the at least one polypeptide is a polypeptide with at least about 70% sequence identity to a polypeptide having the amino acid sequence selected from SEQ ID NOs:1-20 or a fragment thereof.

In one aspect, the sample is blood, plasma, urine, saliva, sweat, organ biopsy, cerebrospinal fluid (CSF), tear, vaginal fluid, feces, skin, and hair. In certain aspects, the sample is a blood sample and the subject is human.

In an additional aspect, the at least one polypeptide is selected is Farnesyl pyrophosphate synthase or a fragment thereof and at least one polypeptide selected from neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, Cognate thermal shock protein 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof. In a further aspect, the at least one polypeptide is a polypeptide with at least about 70% sequence identity to a polypeptide having the amino acid sequence of SEQ ID NO:1 or a fragment thereof and at least one polypeptide with at least about 70% sequence identity to a polypeptide having an amino acid sequence selected from SEQ ID NOs:2-20 or a fragment there of.

In another aspect, the detecting is by protein microarray, fluorescence detection, flow cytometry, microfluidic device, lateral flow assay, vertical flow assay or immunoassay. In a specific aspect, the detecting is by lateral flow. In one aspect, the method also includes administering a treatment to the subject. In certain aspects, the treatment is surgery, radiation, chemotherapy, targeted therapy and/or immunotherapy.

In some embodiments, diagnosing, predicting, and/or monitoring the status or outcome of a cancer may comprise determining a therapeutic regimen. Determining a therapeutic regimen may comprise administering an anti-cancer therapeutic. Alternatively, determining the treatment for the cancer may comprise modifying a therapeutic regimen. Modifying a therapeutic regimen may comprise increasing, decreasing, or terminating a therapeutic regimen.

Treatment options for cervical cancer include surgery, radiation, chemotherapy, targeted therapy, and immunotherapy.

Surgical Treatment for cervical cancer depends on the type and stage of cervical cancer. For precancerous lesion surgical interventions include ablation and excision surgery. Surgical intervention for advanced cervical cancer include hysterectomy (simple or radical) and Trachelectomy.

Radiation is used to treat cervical cancer and to treat cervical cancer recurrence. There are two types of radiation typically used for treating cervical cancer, external beam radiation and brachytherapy. External beam radiation therapy (EBRT) aims x-rays at the cancer from a machine outside the body. Treatment is much like getting a regular x-ray, but the radiation dose is stronger. When EBRT is used as the main treatment for cervical cancer, it is usually combined with chemotherapy. Brachytherapy, or internal radiation therapy, puts a source of radiation in or near the cancer. Brachytherapy is mainly used in addition to EBRT as a part of the main treatment for cervical cancer.

Chemotherapy is also used to treat cervical cancer, wither alone or in combination with another method. Chemotherapy may include Cisplatin, Carboplatin, Paclitaxel (Taxol), Topotecan, docetaxel (Taxotere), ifosfamide (Ifex), 5-fluorouracil (5-FU), irinotecan (Camptosar), gemcitabine (Gemzar) and mitomycin. Targeted therapy for the treatment of cervical cancer includes Bevacizumab. Immunotherapy for the treatment of cervical cancer includes Pembrolizumab (PD-1 inhibitor).

In an additional embodiment, the present invention provides a method of treating cervical cancer in a subject in need thereof, the method is detecting at least one polypeptide in a sample from a subject; wherein the at least one polypeptide is selected from Farnesyl pyrophosphate synthase, neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, Heat shock protein cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof; or a polypeptide with at least about 70% sequence identity to a polypeptide having the amino acid sequence selected from the group consisting of SEQ ID NOs: 1-147 or a fragment thereof; diagnosing cervical cancer based on the detection of the at least one polypeptide; and administering a treatment to the subject. In one aspect, the sample is a blood sample. In one aspect, the at least one polypeptide is a polypeptide with at least about 70% sequence identity to a polypeptide having the amino acid sequence selected from SEQ ID NOs:1-20 or a fragment thereof.

In an additional aspect, the at least one polypeptide is Farnesyl pyrophosphate synthase and at least one polypeptide selected from neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, Heat shock protein cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof. In a further embodiment, the at least one polypeptides is a polypeptide with at least about 70% sequence identity to a polypeptide having the amino acid sequence of SEQ ID NO:1 or a fragment thereof and at least one polypeptide with at least about 70% sequence identity to a polypeptide with an amino acid sequence selected from SEQ ID NOs:2-20 or a fragment thereof.

In another aspect, the detecting is by protein microarray, fluorescence detection, flow cytometry, microfluidic device, lateral flow assay or immunoassay. In a specific aspect, the detecting is by lateral flow assay. In an additional aspect, the treatment is selected from the group consisting of surgery, radiation, chemotherapy, targeted therapy and immunotherapy. In a further aspect, the chemotherapy is Cisplatin, Carboplatin, Paclitaxel, Topotecan, docetaxel, ifosfamide, 5-fluorouracil, irinotecan, gemcitabine or mitomycin. In certain aspects, the targeted therapy is bevacizumab and the immunotherapy is pembrolizumab.

The biomarkers of the present invention can be used to predict response to treatment for cervical cancer.

In a further embodiment, the present invention provides methods of predicting a response to treatment for a subject having cervical cancer by detecting at least one polypeptide in a sample from a subject; wherein the at least one polypeptide is selected from Farnesyl pyrophosphate synthase, neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, heat shock protein cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof, or a polypeptide with at least about 70% sequence identity to a polypeptide having amino acid sequence selected from SEQ ID NOs: 1-147 or a fragment thereof, and predicting a response to treatment based on the detection of the at least one polypeptide. In one aspect, the at least one polypeptide is a polypeptide with at least about 70% sequence identity to a polypeptide having the amino acid sequence selected from SEQ ID NOs:1-20 or a fragment thereof.

In one aspect, the at least one polypeptide is Farnesyl pyrophosphate synthase or a fragment thereof and at least one polypeptide selected from neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, Heat shock protein cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof. In another aspect, the at least one polypeptide is a polypeptide with at least about 70% sequence identity to a polypeptide having the amino acid sequence of SEQ ID NO:1 or a fragment thereof and at least one polypeptide with at least about 70% sequence identity to a polypeptide having the amino acid sequence selected from SEQ ID NOs:2-20 or a fragment thereof.

In an additional aspect, the detecting is by protein microarray, fluorescence detection, flow cytometry, microfluidic device, lateral flow assay, vertical flow or immunoassay. In a further aspect, the detecting is by lateral flow assay. In certain aspects, the treatment is surgery, radiation, chemotherapy, targeted therapy and immunotherapy.

The biomarkers of the present application are useful for determining the stage of cervical cancer. Cervical cancer can be classified on different scales. The Papanicolau system classifies the lesions in degrees of severity, from grade I that corresponds to normal cytology, to grade V that corresponds to invasive squamous cancer of the cervix. The Richart classification system classifies the results of a cytology into: Negative, Reactive or not classifiable squamous atypical, HPV infection, Cervical intraepithelial neoplasia (CIN) grades I, II and III, carcinoma in situ and invasive squamous cancer of the cervix. Finally, the Bethesda nomenclature classifies the results of a cytology as: Negative, ASCUS-ASCH, low-grade intraepithelial lesions, high-grade intraepithelial lesions and invasive squamous cancer of the cervix.

The FIGO (International Federation of Gynecology and Obstetrics) staging system is used most often for cancers of the female reproductive organs, including cervical cancer. For cervical cancer, the clinical stage is used and is based on the results of the doctor's physical exam, biopsies, imaging tests, and a few other tests that are done in some cases, such as cystoscopy and proctoscopy.

TABLE 2

| FIGO Stage | | Stage description |
|---|---|---|
| I | IA | The cancer cells have grown from the surface of the cervix into deeper tissues of the cervix. |
| | | Cancer has not spread to nearby lymph nodes. |
| | | Cancer has not spread to distant sites. |
| | | It has not spread to distant sites. |
| | IA1 | The area of cancer can only be seen with a microscope and is less than 3 mm (about ⅛-inch) deep. |
| | | It has not spread to nearby lymph nodes. |
| | | It has not spread to distant sites. |
| | IA2 | The area of cancer can only be seen with a microscope and is between 3 mm and 5 mm (about ⅕-inch) deep. |
| | | It not has not spread to nearby lymph nodes. |
| | | It has not spread to distant sites. |
| | IB | This includes stage I cancer that has spread deeper than 5 mm (about ⅕ inch) but is still limited to the cervix. |
| | | It has not spread to nearby lymph nodes. |
| | | It has not spread to distant sites. |
| | IB1 | The cancer is deeper than 5 mm (about ⅕-inch) but not more than 2 cm (about ⅘-inch) in size. |
| | | It has not spread to nearby lymph nodes. |
| | | It has not spread to distant sites. |
| | IB2 | The cancer is at least 2 cm in size but not larger than 4 cm. |
| | | It has not spread to nearby lymph nodes. |
| | | It has not spread to distant sites. |
| | IB3 | The cancer is at least 4 cm in size and limited to the cervix. |
| | | It has not spread to nearby lymph nodes. |
| | | It has not spread to distant sites. |
| II | | The cancer has grown beyond the cervix and uterus, but hasn't spread to the walls of the pelvis or the lower part of the vagina. |
| | | It has not spread to nearby lymph nodes. |
| | | It has not spread to distant sites. |
| | IIA | The cancer has grown beyond the cervix and uterus but has not spread into the tissues next to the cervix (called the parametria). |
| | | It has not spread to nearby lymph nodes. |
| | | It has not spread to distant sites. |
| | IIA1 | The cancer is not larger than 4 cm (about 1⅗ inches). |
| | | It not has not spread to nearby lymph nodes. |
| | | It has not spread to distant sites. |
| | IIA2 | The cancer is 4 cm or larger. |
| | | It has not spread to nearby lymph nodes. |
| | | It has not spread to distant sites. |
| | IIB | The cancer has grown beyond the cervix and uterus and has spread into the tissues next to the cervix (the parametria). |
| | | It has not spread to nearby lymph nodes. |
| | | It has not spread to distant sites. |
| III | | The cancer has spread to the lower part of the vagina or the walls of the pelvis. The cancer may be blocking the ureters (tubes that carry urine from the kidneys to the bladder). |
| | | It might or might not have not spread to nearby lymph nodes. |
| | | It has not spread to distant sites. |
| | IIIA | The cancer has spread to the lower part of the vagina but not the walls of the pelvis. |
| | | It has not spread to nearby lymph nodes. |
| | | It has not spread to distant sites. |
| | IIIB | The cancer has grown into the walls of the pelvis and/or is blocking one or both ureters causing kidney problems (called hydronephrosis). |
| | | It has not spread to nearby lymph nodes. |
| | | It has not spread to distant sites. |
| | IIIC | The cancer can be any size. |
| | | Imaging tests or a biopsy show the cancer has spread to nearby pelvic lymph nodes (IIIC1) or para-aortic lymph nodes (IIIC2). |
| | | It has not spread to distant sites. |
| IV | | The cancer has grown into the bladder or rectum or to far away organs like the lungs or bones. |
| | IVA | The cancer has spread to the bladder or rectum or it is growing out of the pelvis. |
| | IVB | The cancer has spread to distant organs outside the pelvic area, such as distant lymph nodes, lungs or bones. |

In another embodiment, the present invention provides methods for determining the stage of cervical cancer in a subject in need thereof by detecting at least one polypeptide in a sample from the subject; wherein the at least one polypeptide is selected from Farnesyl pyrophosphate synthase, neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, heat shock protein cognate 71 kDa, Ankyrin-3, Rho 23GTPase-activating protein, Cytoskeletal Keratin 78 type II, Alpha-3 collagen chain (VI), Beta subunit of proteasome type-5, Heterogeneous nuclear ribonucleoproteins A2/B31, Histone H2B type 1-B, homolog of DnaJ subfamily C member 13, Beta enolase, Glutathione S-transferase P, Glutathione S-transferase Mu 3 or a fragment thereof, or a polypeptide with at least about 70% sequence identity to a polypeptide having the amino acid sequence selected from SEQ ID NOs: 1-147 or a fragment thereof, and determining the stage of cervical cancer in the subject based on the detection of the at least one polypeptide. In one aspect, the at least one polypeptide is a polypeptide having the amino acid sequence selected from SEQ ID NOs:1-20 or a fragment thereof.

In one aspect, the at least one polypeptide is Farnesyl pyrophosphate synthase or a fragment thereof and at least one polypeptide selected from neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, Heat shock protein cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof. In another aspect, the at least one polypeptide is a polypeptide with at least about 70% sequence identity to a polypeptide having the amino acid sequence of SEQ ID NO:1 or a fragment thereof and at least one polypeptide with at least about 70% sequence identity to a polypeptide having the amino acid sequence selected from SEQ ID NOs:2-20 or a fragment thereof.

In an additional aspect, the detecting is by protein microarray, fluorescence detection, flow cytometry, microfluidic device, lateral flow assay, vertical flow assay or immunoassay. In a specific aspect, the detecting is by lateral flow assay. In a further aspect, the method also includes administering a treatment to the subject. In certain aspects, the treatment is surgery, radiation, chemotherapy, targeted therapy or immunotherapy. In one aspect, the cervical cancer is stage I, stage II, stage III or stage IV.

In one embodiment, the present invention provides a kit with a sample collection unit; a lateral flow device; and instructions for using the lateral flow device.

Sample collection device is any device that can be used to collect a sample. The sample blood, plasma, urine, saliva, sweat, organ biopsy, cerebrospinal fluid (CSF), tear, vaginal fluid, feces, skin, and hair.

A lateral flow device is a simple to use diagnostic device used to confirm the presence or absence of a target analyte, such as pathogens or biomarkers in a sample. The most commonly known type of lateral flow rapid test strip is the pregnancy test.

Typically lateral flow assays use a device comprises several pads (made of a series of capillary beds, capable of transporting a fluid): a sample pad to receive the liquid sample; a conjugate pad, including reactive molecules used to visualize positive control, a positive line and a test line.

For the detection of a target protein, the conjugate pad includes antibodies specific for the target protein conjugated to a detectable tag; a positive line (positive control) is generated comprising fixed anti-anti-target protein antibodies (for example anti IgG antibodies), and a test line was generated comprising fixed anti-target protein antibodies. When the sample pad is contacted with a sample containing the target protein, the target protein reacts with the anti-target protein antibodies conjugated to a detectable tag in the conjugate pad. As the liquid flows to the test and positive lines, the target protein present in the sample, conjugated with the labeled antibodies reacted with the fixed anti-target protein antibodies on the test line, and anti-target protein antibodies conjugated to the detectable tag but not conjugated to the target protein reacts with the fixed anti-Ig antibodies on the positive line. Both reactions generate a positive reading on the test line, and on the positive line.

In one aspect, the lateral flow device detects at least one polypeptide selected from Farnesyl pyrophosphate synthase, neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, heat shock protein cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof; or a polypeptide with at least about 70% sequence identity to a polypeptide having the amino acid sequence selected from SEQ ID NOs: 1-147 or a fragment thereof. In one aspect, the at least one polypeptide is a polypeptide with at least about 70% sequence identity to a polypeptide having the amino acid sequence selected from SEQ ID NOs:1-20 or a fragment thereof.

In an additional aspect, the at least one polypeptide is Farnesyl pyrophosphate synthase or a fragment thereof and at least one polypeptide selected from neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, heat shock protein cognate 71 kDa, Ankyrin-3, Rho 23 GTPase-activating protein, Cytoskeletal Keratin 78 type II, Alph-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof. In a further aspect, the at least one polypeptide with at least about 70% sequence identity to a polypeptide having the amino acid sequence of SEQ ID NO:1 or a fragment thereof and at least one polypeptide selected from a polypeptide with at least about 70% sequence identity to a polypeptide having the amino acid sequence selected from SEQ ID NO:2-20 or a fragment thereof.

In another aspect, the lateral flow device detects the at least one polypeptide by an immunoassay. In one aspect, the sample collection unit collects a blood sample.

In an additional embodiment, the present invention provides a use of the detection of at least one polypeptide for the diagnosis of cervical cancer in a subject in need thereof, wherein the at least one polypeptide is selected from Farnesyl pyrophosphate synthase, neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, heat shock protein cognate 71 kDa, Ankyrin-3, Rho 23 GTPase-activating protein, Cytoskeletal Keratin 78 type II, Alpha-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof, or a polypeptide with at least about 70% sequence identity to a polypeptide having the amino acid sequence selected from SEQ ID NOs: 1-147 or a fragment thereof. In one aspect, the at least one polypeptide is a polypeptide with at least about 70% sequence identity to a polypeptide having the amino acid sequence selected from SEQ ID NOs:1-20 or a fragment thereof.

In a further aspect, the at least one polypeptide is detected in a sample from the subject and the sample is a blood sample. In another aspect, the at least one polypeptide is Farnesyl pyrophosphate synthase or a fragment thereof and at least one polypeptide selected from neurofibromin I, Glyceraldehyde-3 phosphate dehydrogenase, Protein 1 containing fibronectin domain type III, Eukaryotic initiation factor 4A-I, L-lactate dehydrogenase chain B, Nuclear heterogeneous Ribonucleoprotein A1, 1-like protein 1 polycystic kidney disease, heat shock protein cognate 71 kDa, Ankyrin-3, Rho 23 GTPase-activating protein, Cytoskeletal Keratin 78 type II, Alph-3 collagen chain (VI), Beta subunit of proteasome type-5, Heterogeneous nuclear ribonucleoproteins A2/B1, Histone H2B type 1-B, homolog of DnaJ subfamily C member 13, Beta enolase, Glutathione S-transferase P, Glutathione S-transferase Mu 3 or a fragment thereof. In one aspect, the at least one polypeptide is a polypeptide with at least about 70% sequence identity to a polypeptide having the amino acid sequence of SEQ ID NO:1 or a fragment thereof and at least one polypeptide with at least about 70% sequence identity to a polypeptide having the amino acid sequence selected from SEQ ID NOs:2-20 or a fragment thereof.

In another aspect, the detecting is by protein microarray, fluorescence detection, flow cytometry, microfluidic device, lateral flow assay, vertical flow assay or immunoassay. In certain aspects, the detecting is by lateral flow assay.

The following examples are provided to further illustrate the embodiments of the present invention, but are not intended to limit the scope of the invention. While they are typical of those that might be used, other procedures, methodologies, or techniques known to those skilled in the art may alternatively be used.

EXAMPLES

Example 1

Secretome Analysis of Cervical Cancer Cell Lines

In order to identify cervical cancer biomarkers, a secretome analysis of cervical cancer cells was performed using cervical cancer cell line HeLa (cervical adenocarcinoma, positive for HPV18), SiHa cells (grade II, squamous cell cervical carcinoma, positive for HPV16), and C-33A (cervical carcinoma, negative for HPV) and the HaCaT cell line as a negative control. These lines were selected because they represent the most frequent histological types and viral genotypes in cervical intraepithelial lesions and in CC; and were either cultured (in vitro secretome), or inoculated into mice (ex vivo secretome).

Figure 2:
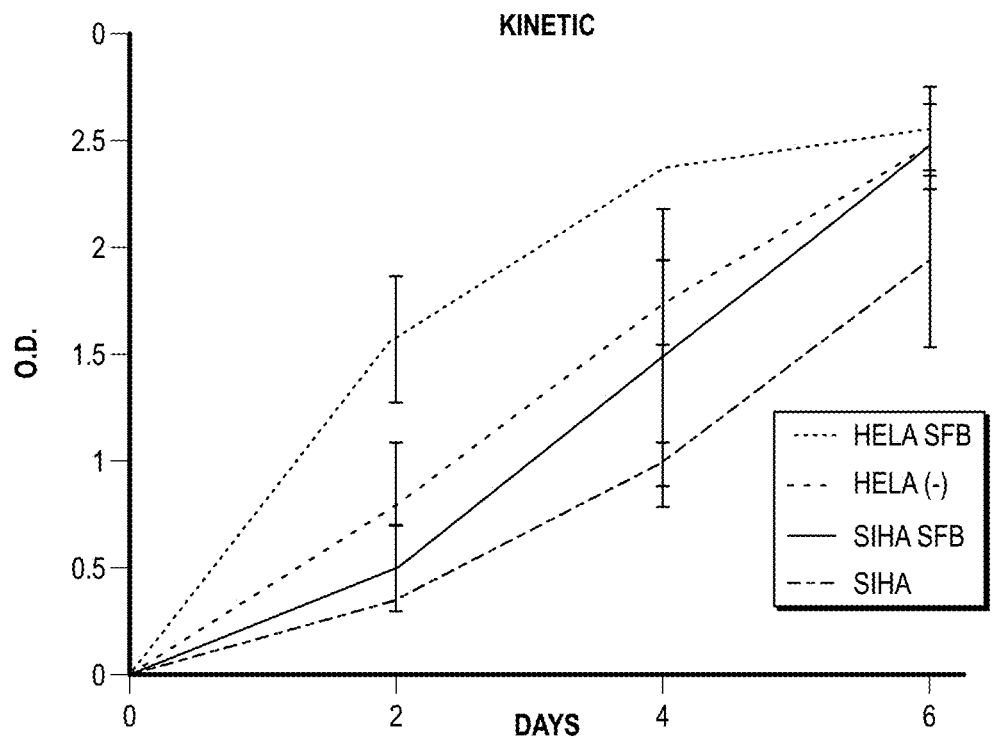
FIG. 2 is a graph showing the growth kinetics of cell lines with and without fetal bovine serum (FBS).

HeLa and SiHa cells were cultured in serum-free Advanced RPMI 1640 supplemented with 2 mM L-glutamine and Penicillin-Streptomycin at 1% v/v, at 37° C. and with 5% $CO_2$ until a 70-80% confluence was reached. The cells were washed three times with sterile physiological solution (0.9% NaCl (w/v)). As illustrated in FIG. 2, there was no significant growth differences between the cells at day 6, when the cells reached 70% confluence.

For in vitro secretome analysis, the cells were then incubated in serum-free RPMI 1640 without phenol red (Gibco, Invitrogen) for 20 hours, and the medium collected and centrifuged at 1,500 g for 5 minutes. The supernatant was passed through a 0.22 μm size PVDF membrane (Millex, Millipore) and stored at −70° C. until further use (see FIG. 1).

For in vitro secretome analysis, the cells were then incubated in serum-free RPMI 1640 without phenol red for 20 hours, and the medium collected and centrifuged at 1,500 g for 5 minutes. The supernatant was passed through a 0.22 μm size PVDF membrane and stored at −70° C. until further use (see FIG. 1).

For the ex vivo secretome analysis, the secreted proteins were collected from tumors collected on female Nu/Nu mice (4-6 weeks) inoculated with $10^7$ HeLa or SiHa cells. After 30, 45 and 50 days after inoculation, the tumors were collected (triplicate) and washed 3 times with 50 mL of physiological solution and then incubated for 20 hours with serum free RMPI medium without phenol red. The medium was removed and centrifuged at 1,500×g for 5 minutes, the supernatant was passed through a 0.22 μm pore size membrane PVDF membrane and stored at −70° C. until further use (see FIG. 1). The secreted proteins collected in vitro and ex vivo were lyophilized and resuspended in 1 mL of ultrapure water. Protein isolation was performed by phenol extraction.

Figure 3A:
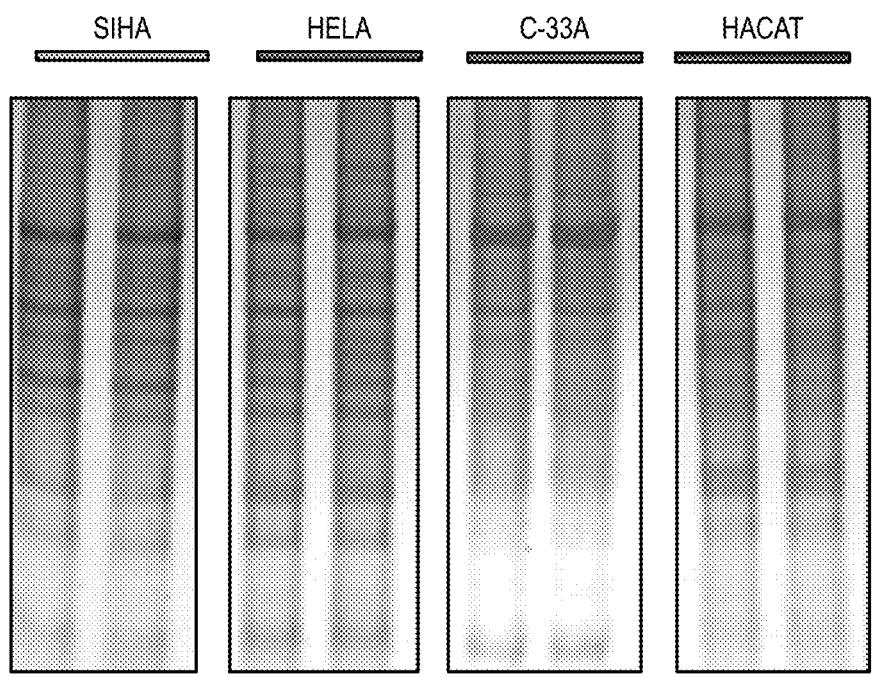
FIG. 3A show analysis of the cervical cancer line secretome and its negative control.

To identify the proteins secreted by the different cell lines, the proteins were separated by electrophoresis on an SDS-PAGE matrix and stained with bright Coomassie blue (see FIG. 3A). Each lane containing 30 μg protein was cut into 20 lines throughout the column, the proteins contained were extracted and digested with trypsin. The generated peptides were analyzed in a nano LC-MS/MS system. The identification of peptides and proteins was performed using the MASCOT search engine through the MASCOT Distiller interface. The databases consulted were Swiss-Prot and NCBI.

Figures 3B, 3C:
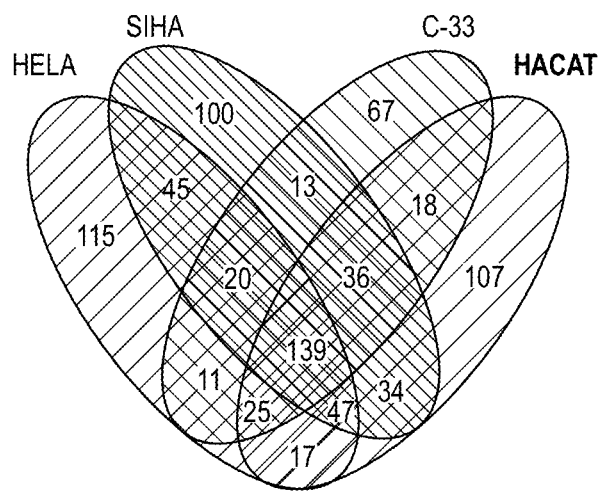
FIG. 3B illustrates the number of total protein in each cell line, the number of unique protein, and the protein shared between cell lines.
FIG. 3C is a graphical representation of the data presented in FIG. 3B.
Figure 4A:
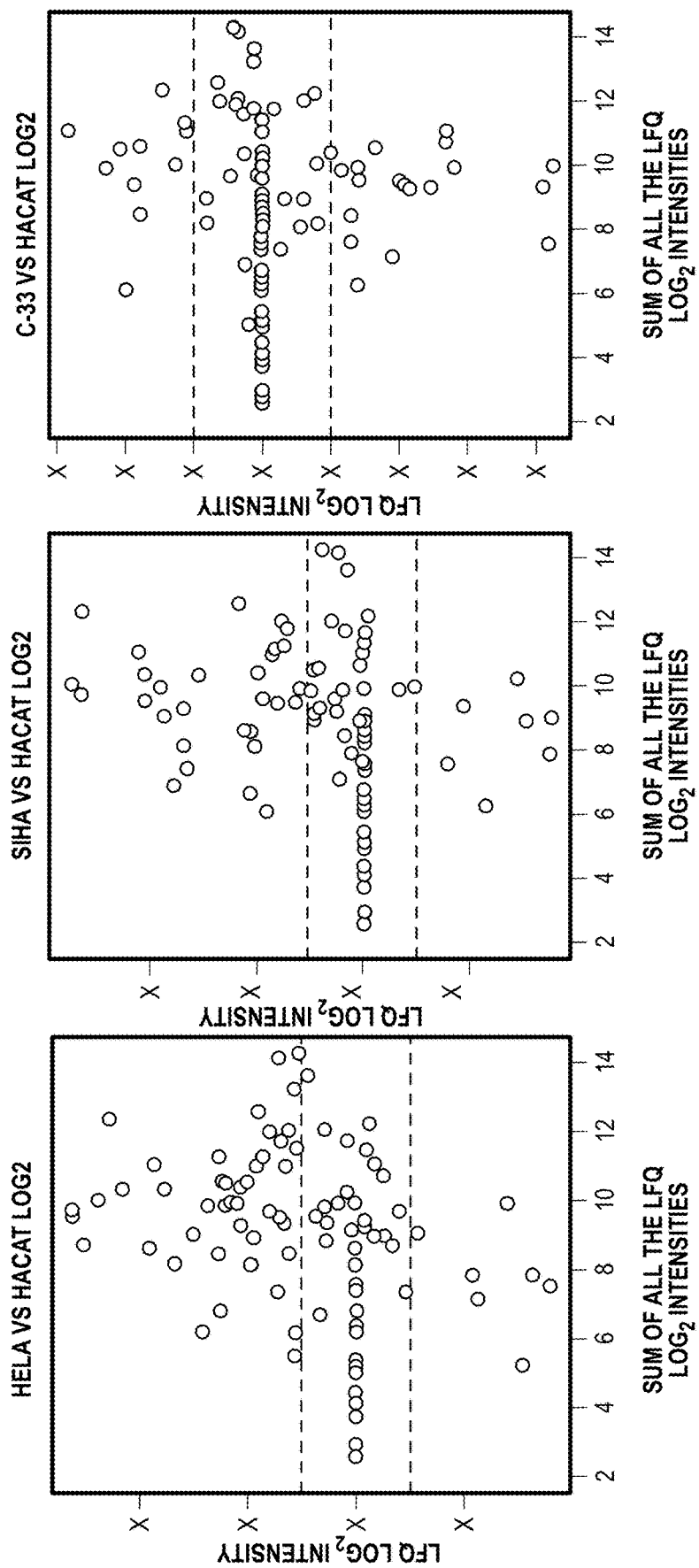
FIG. 4A shows a dotplot graph illustrating the label-free quantification (LFQ) of 200 CC cell line secretome proteins vs. their negative control.
Figure 4B:
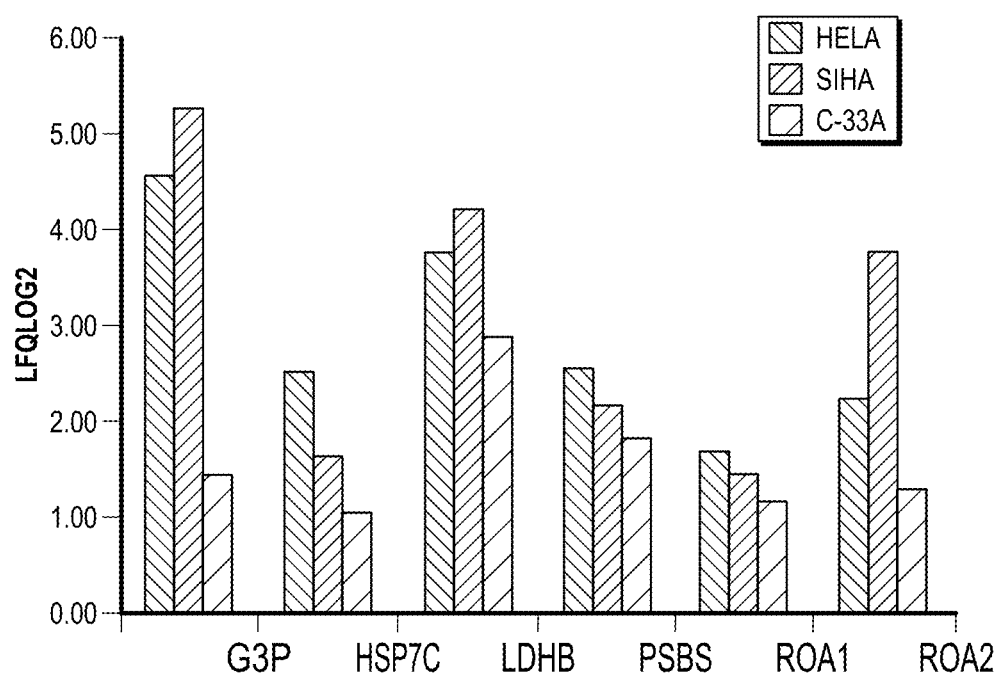
FIG. 4B is a graph bar representing the expression profile of proteins of interest.
Figure 4C:
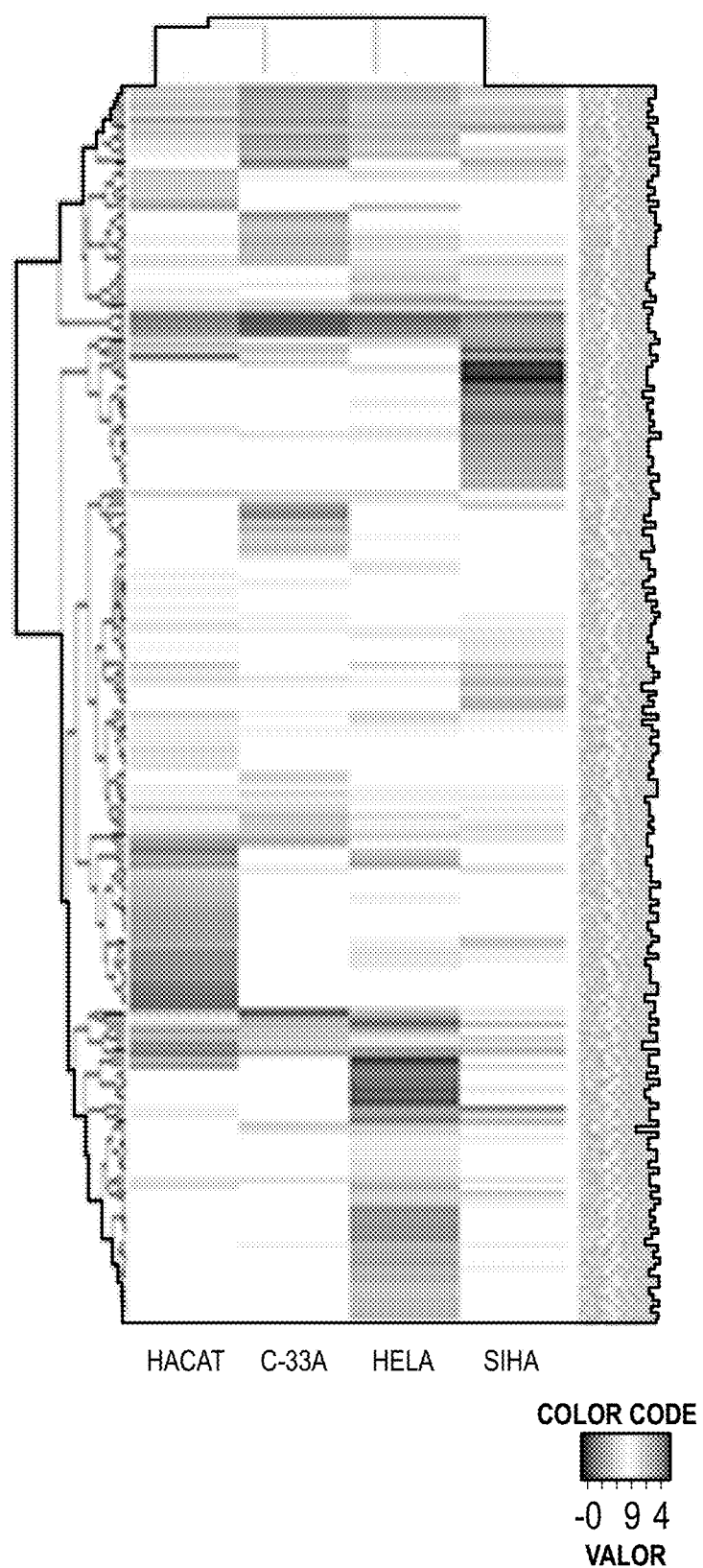
FIG. 4C is a heat map illustrating the label-free quantification (LFQ) of 200 CC cell line secretome proteins vs. their negative control.

1662 secretome proteins were identified (see FIG. 3B). As illustrated in the Venn diagram of FIG. 3C, showing the intersection between the shared proteins of the CC cell lines and their negative control, 20 proteins were shared in the 3 CC cell lines and absent in the negative control (see Table 3). These proteins were candidates for use in a rapid diagnostic test. In addition to the qualitative study, a quantitative analysis of 200 secreted proteins was performed using the label-free quantification (LFQ) technique. As shown in FIG. 4A, 92 proteins were found over-expressed in the 3 CC cell lines according to their Log 2 value (CC cell lines vs. HaCaT). For HeLa: 45 over-expressed proteins, SiHa: 35 over-expressed proteins, C-33A: 12 over-expressed proteins. As shown in FIG. 4B, 6 secreted proteins: Glyceraldehyde-3-phosphate dehydrogenase, cognate heat shock protein 71 kDa, L-lactate dehydrogenase chain B, beta subunit of proteasome type-5 and nuclear ribonucleoproteins heterogeneous A2/B1 were found over expressed in the 3 CC cell lines compared to its negative control. Further, and as shown in FIG. 4C (which represents the Heat map of proteins expressed in cell lines, where the complete linkage hierarchical grouping shows the values in Log 2 (protein expression/HSP71) on a color scale), the hierarchy analysis by cluster in the heat map revealed a similarity in protein expression between the HPV positive cell lines (SiHa and HeLa). These analyzes allowed obtaining a set of common over-expressed proteins for the HPV and CC lines.

TABLE 3

| Gene | Protein | Name |
|---|---|---|
| NF1 | NF1_HUMAN | Neurofibromin |
| GAPDH | G3P_HUMAN | Glyceraldehyde-3 phosphate dehydrogenase |
| FNDC1 | FNDC1_HUMAN | Protein 1 containing fibronectin domain type III |
| EIF4A1 | IF4A1_HUMAN | Eukaryotic initiation factor 4A-I |
| LDHB | LDHB_HUMAN | L-lactate dehydrogenase chain B |
| HNRNPA1 | ROA1_HUMAN | Nuclear heterogeneous Ribonucleoprotein A1 |
| PKD1L1 | PK1L1_HUMAN | Polycystic kidney disease protein 1-like 1 |
| FDPS | FPPS_HUMAN | Farnesyl pyrophosphate synthase |
| HSPA8 | HSP7C_HUMAN | Heat Shock Protein Cognate 71 kDa |
| ANK3 | ANK3_HUMAN | Ankirin-3 |
| ARHGAP23 | ARHG23_HUMAN | Rho 23 GTPase-activating protein |
| KRT78 | K2C78_HUMAN | Cytoskeletal Keratin 78 type II |
| COL6A3 | CO6A3_HUMAN | Alpha-3 collagen chain (VI) |
| PSMB5 | PSB5_HUMAN | Beta subunit of proteasome type-5 |
| HNRNPA2B1 | ROA2_HUMAN | Heterogeneous nuclear ribonucleoproteins A2/B1 |
| HIST1H2BB | H2B1B_HUMAN | Histone H2B type 1-B |
| RME8 | DNAJC13 | homolog of DnaJ subfamily C member 13 |
| ENO3 | ENOB_HUMAN | Beta enolase |
| GSTP1 | GSTP1_HUMAN | Glutathione S-transferase P |
| GSTM3 | GSTM3_HUMAN | Glutathione S-transferase Mu 3 |

Example 2

Detection of Cervical Tumors

Figure 5A:
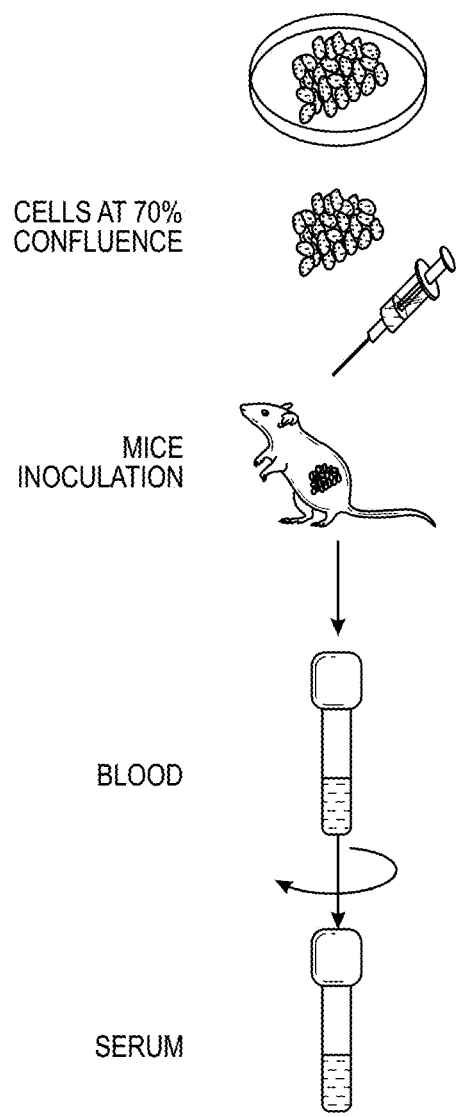
FIG. 5A illustrates the workflow to collect blood and serum samples.

To evaluate if the proteins identified in the in vitro secretome analysis could be used as biomarkers for the detection of cervical tumors, female mice were inoculated with DC cells to develop tumors, and secreted proteins were measured in the serum of the animals (see FIG. 5A).

A cohort of 9 mice was generated, with 3 different cell lines and their controls established at 3 different times of the PT (tumor progression). The mice were inoculated with $10^7$ cells DC tumor cell lines (either HeLa or SiHa cells), and the sera were collected 30, 45 and 50 days post inoculation. Sera were subjected to a Western blot with 20 µg protein per sample. The tests were performed in triplicate and were presented as means (±standard deviation). A statistical Student's t-test was performed.

Figure 5B:
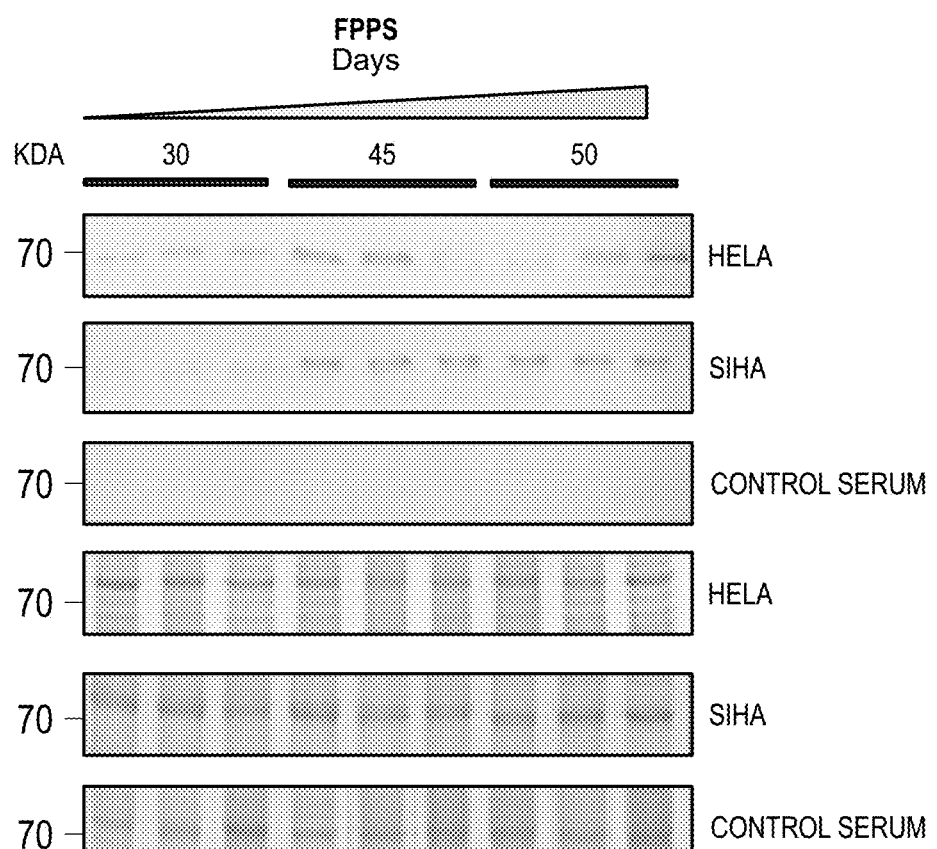
FIG. 5B illustrate the western blot analysis of FPS (farnesyl pyrophosphatase) in mouse sera.
Figure 5C:
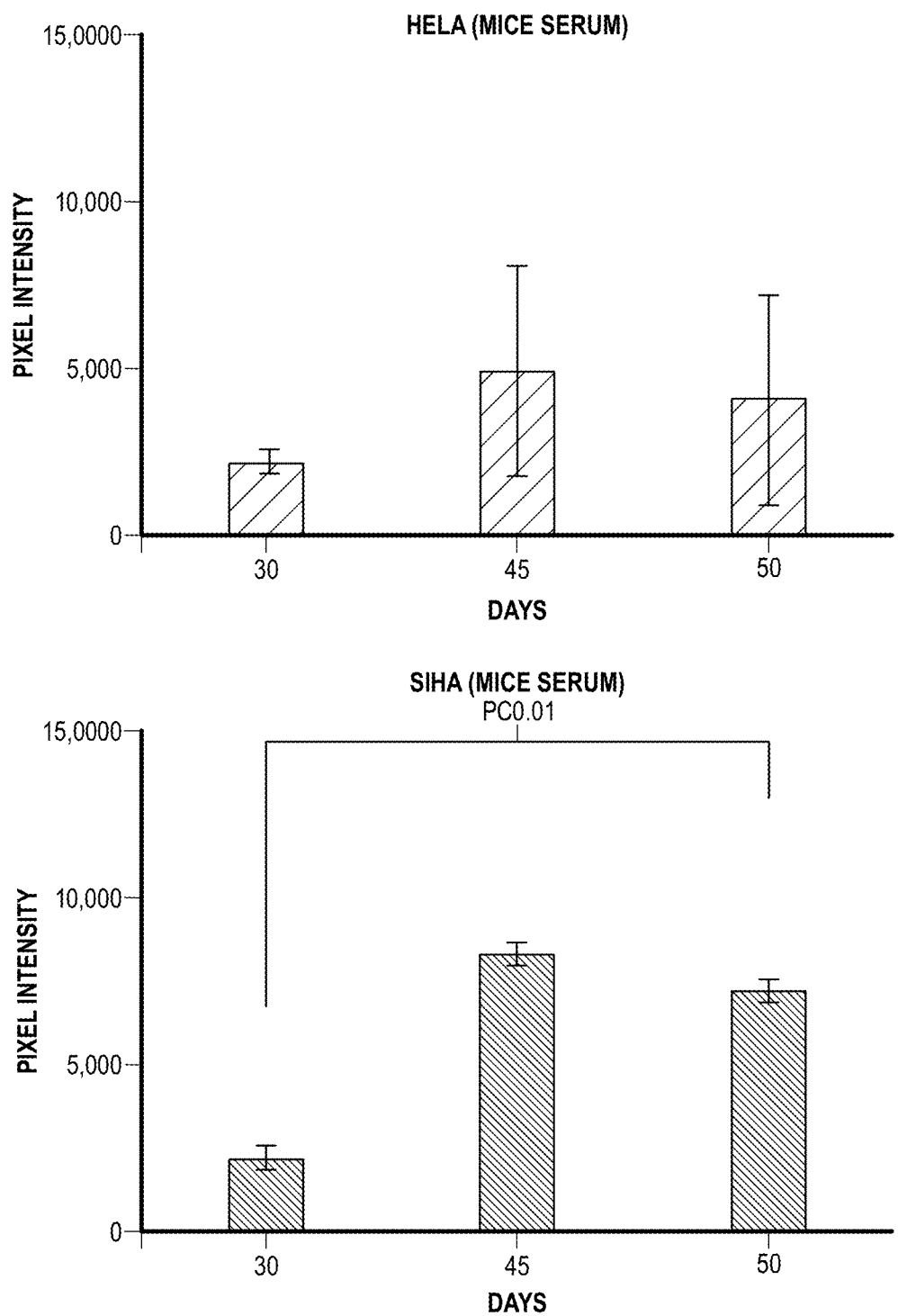
FIG. 5C illustrates the quantification of the data presented in FIG. 5B.

As illustrated in FIG. 5B, illustrating the example of the detection of one of the protein of the secretome identified in Example 1; it was found by Western blot that the farnesyl pyrophosphate synthase protein was detectable in the sera of the mice inoculated with HeLa and SiHa (sera from uninoculated mice were used as controls). The protein was found expressed in all sera of the tumor-bearing mice, an as detailed in FIG. 5C, the level of expression was found to increase levels over time in the sera of the mice inoculated with SiHa.

Figure 6A:
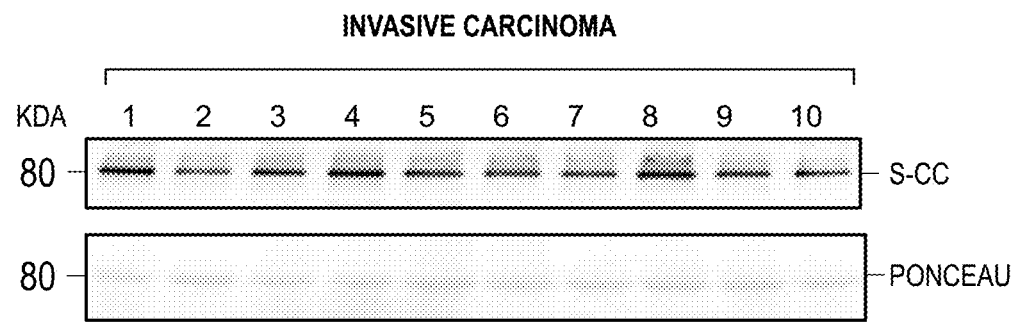
FIG. 6A illustrates the validation of the candidate protein Farnesyl pyrophosphate synthase in the sera of patients with CC.
Figure 6B:
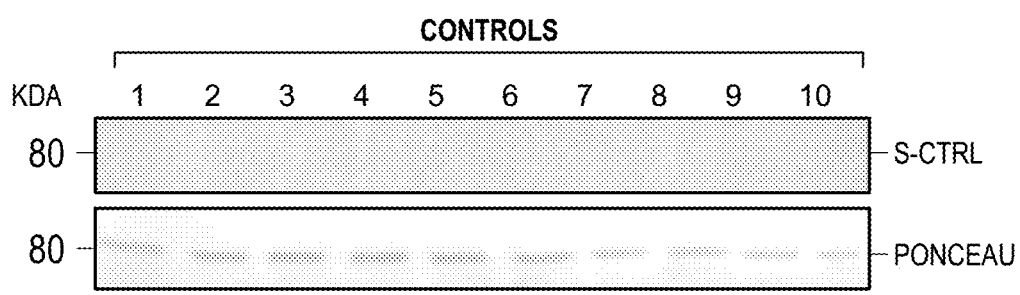
FIG. 6B illustrates the level of Farnesyl pyrophosphate synthase protein detected in the sera of control patients.
Figure 6C:
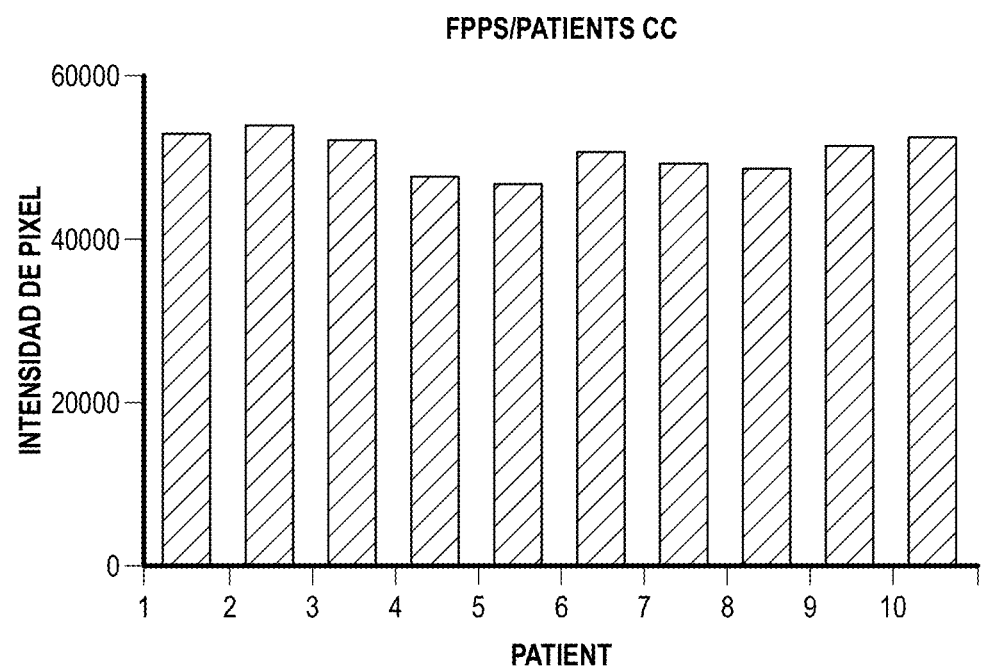
FIG. 6C illustrates the quantification of the data presented in FIGS. 6A and 6B.
Figure 6C:
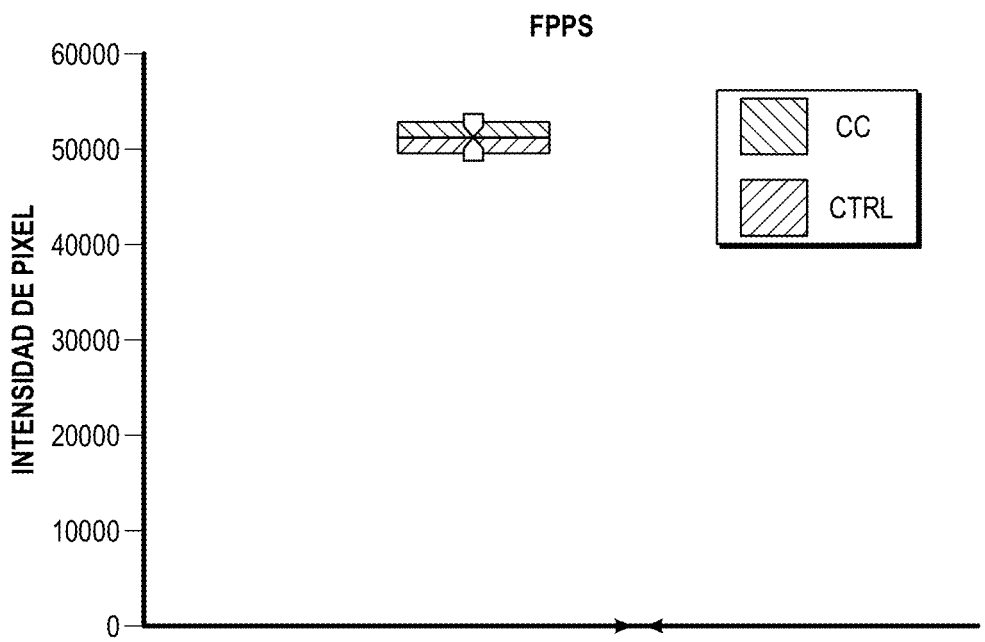
Figure 7A:
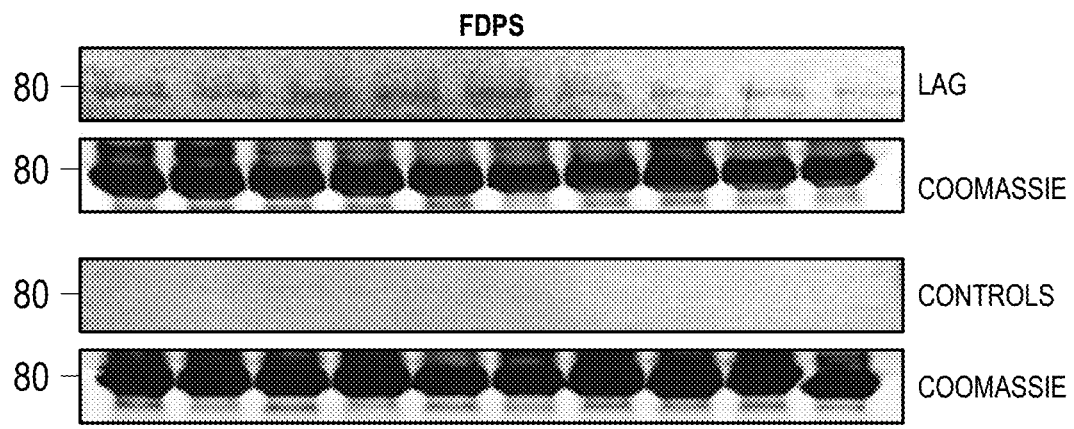
FIG. 7A illustrates the validation of the candidate protein Farnesyl pyrophosphate synthase in precancerous cervical lesions.
Figure 7B:
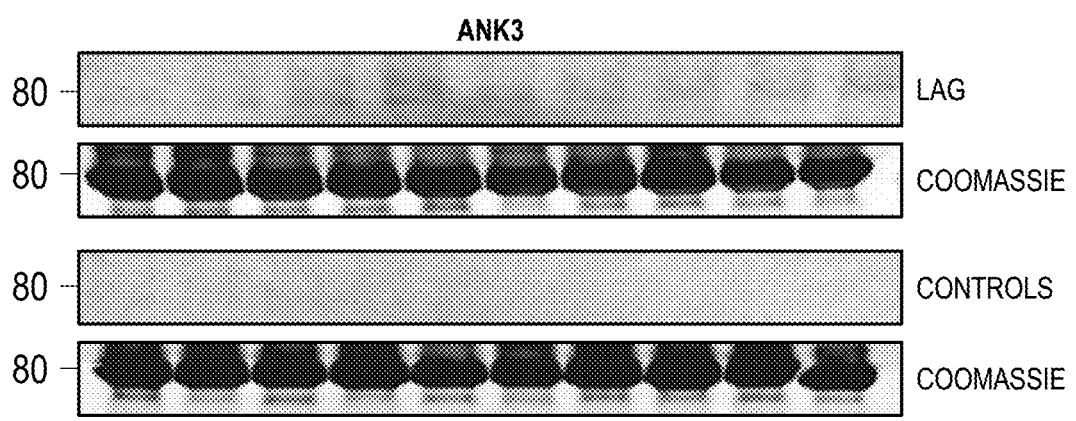
FIG. 7B illustrates the validation of the candidate protein Ankyrin-3 in precancerous cervical lesions.
Figure 7C:
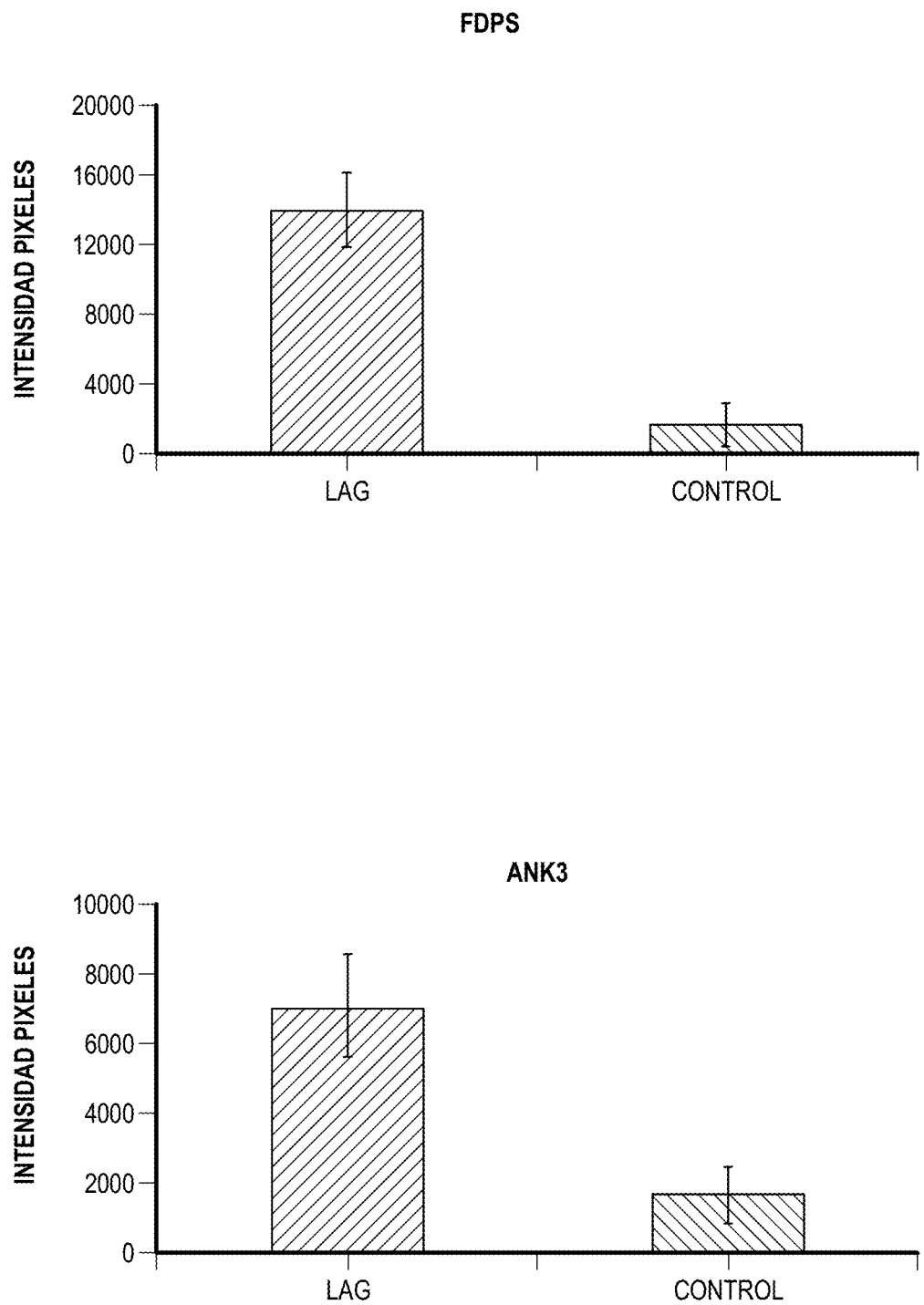
FIG. 7C illustrates the quantification of the data presented in FIGS. 7A and 7B.

The validation of the protein Farnesyl pyrophosphate synthase as a biomarker in sera was further performed in serum obtain from patients with CC:

The serum of 10 patients with CC and 10 negative controls for CC were tested, and the expression of Farnesyl pyrophosphate synthase was assessed by western blot. As illustrated in FIGS. 6A and 6B, all the patients analyzed presented Farnesyl pyrophosphate synthase expression, and no expression of Farnesyl pyrophosphate synthase was found in the sera of the controls. It was also observed that the level of expression was variable among patients (see FIG. 6C). As further illustrated in FIGS. 7A-7C, Ankyrin-3 was also demonstrated as a promising biomarker that can be used to detect cervical cancer in the serum of patient, by presenting with a significantly higher level of expression as compared to the serum of control patients. The proteome analysis of the secretome, identified 20 proteins present in CC cells and absent in negative control; and among the 6 overexpressed proteins Farnesyl pyrophosphate synthase and Ankyrin-3, used an a proof-of-principle were used to demonstrate that its level of expression (i.e., overexpression) could be analyzed in the serum of patient, showing that these proteins may be a useful promising candidate in the identification of this disease.

Example 3

Detection of Pre-Cancerous Cervical Lesions

To evaluate if the proteins identified in the in vitro secretome analysis could be used as biomarkers to detect pre-cancerous cervical lesions, the serum of patient presenting pre-cancerous cervical lesions were assessed for the detection of the biomarkers by western blot.

The serum of patients with pre-neoplasic lesions, with cervical cancer or with no lesions (control) were collected and analyzed for the expression of Ankyrin-3, Rho 23 GTPase-activating protein, Alpha-3 collagen chain (IV), Beta enolase, Farnesyl pyrophosphate synthase, Histone H2B type 1-BB, Heterogeneous nuclear ribonucleoproteins A2/B1, Heat shock protein cognate 71 kDa, Cytoskeletal Keratin 78 type II, Beta subunit of proteasome type-5 and homolog of DnaJ subfamily C member 13.

Figure 8A:
FIG. 8A illustrates the detection of Farnesyl pyrophosphate synthase by western blot in the sera of patients with pre-cancerous lesions L1.
Figure 8B:
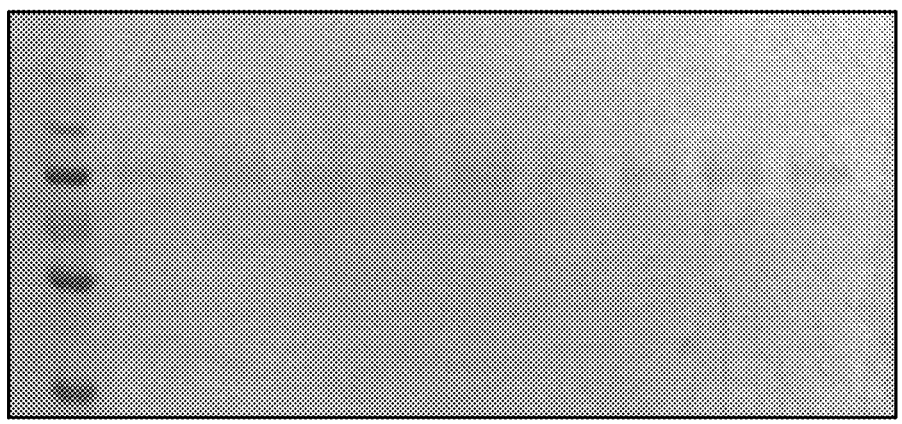
FIG. 8B illustrates the detection of Farnesyl pyrophosphate synthase by western blot in the sera of patients with pre-cancerous lesions L2.
Figure 8C:
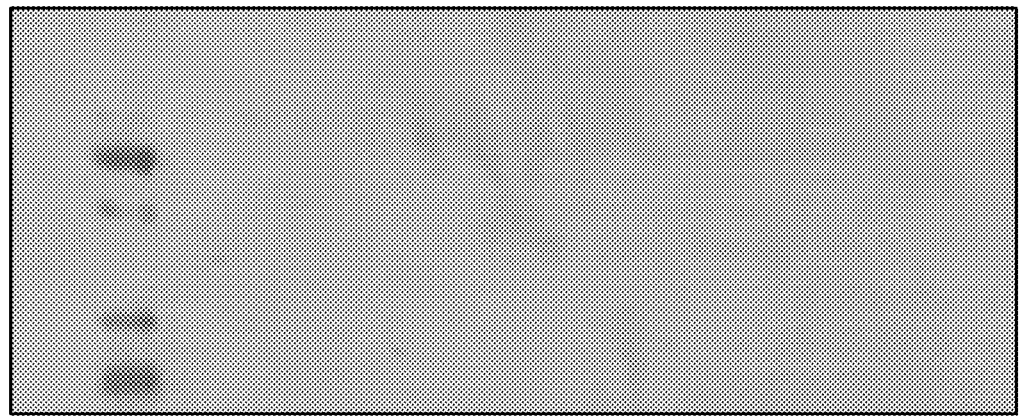
FIG. 8C illustrates the detection of Farnesyl pyrophosphate synthase by western blot in the sera of control patients.
Figure 8D:
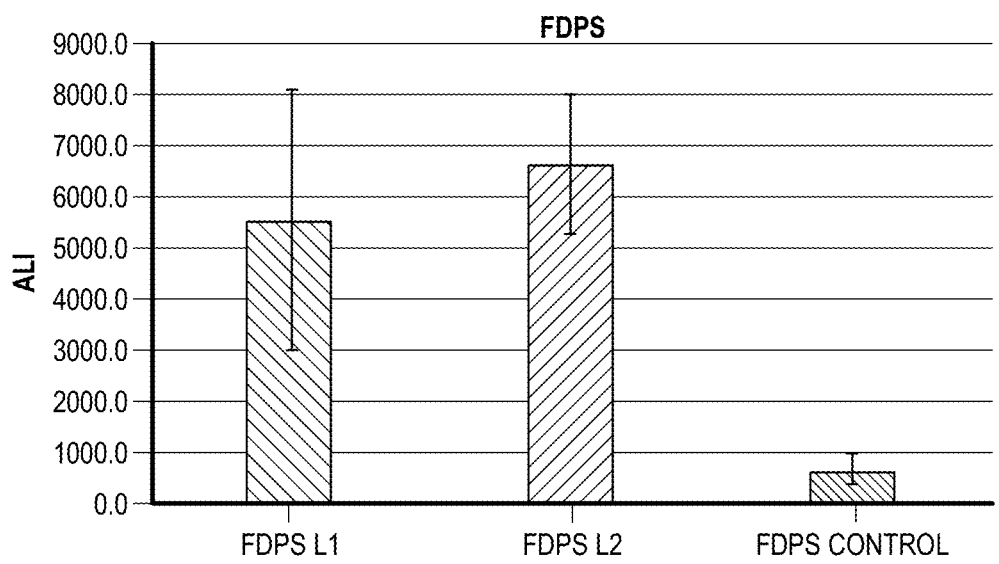
FIG. 8D illustrates the quantification of the data provided in FIG. 8A-8C.

As illustrated in FIGS. 8A-8C, it was demonstrated that Farnesyl pyrophosphate synthase was detectable in the serum of patient having pre-cancerous cervical lesions L1 and L2, as compared to control sera. Specifically, it was found that Farnesyl pyrophosphate synthase expression was 12-times higher in the serum of patient with pre-cancerous lesions as compared to control (see FIG. 8D), demonstrating that pre-cancerous lesions, as well as cancerous (see example 2) can be detected in the serum of patient, by detecting the expression of Farnesyl pyrophosphate synthase in the serum, which can be used as a biomarker for the detection of precancerous cervical lesions.

Figure 9A:
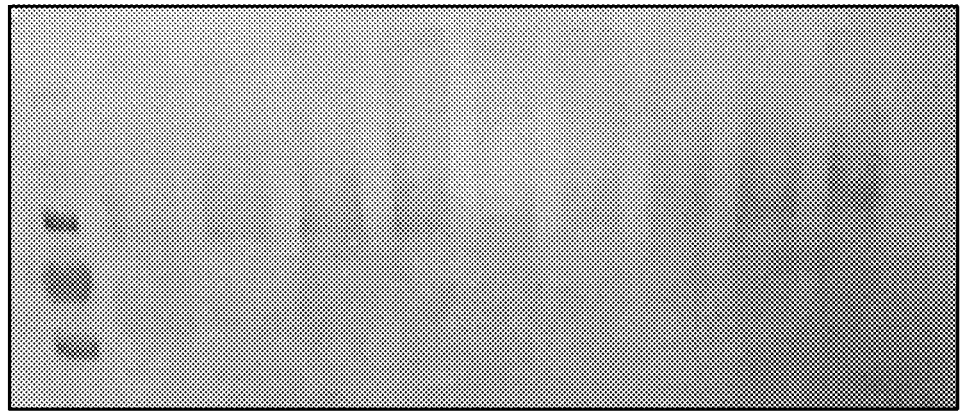
FIG. 9A illustrates the detection of Ankyrin-3 by western blot in the sera of patients with pre-cancerous lesions L.
Figure 9B:
FIG. 9B illustrates the detection of Ankyrin-3 by western blot in the sera of patients with pre-cancerous lesions L2.
Figure 9C:
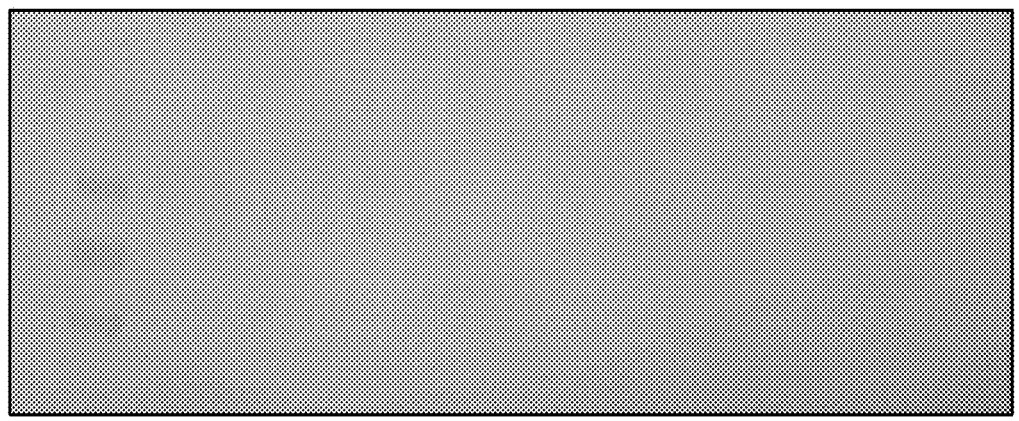
FIG. 9C illustrates the detection of Ankyrin-3 by western blot in the sera of control patients.
Figure 9D:
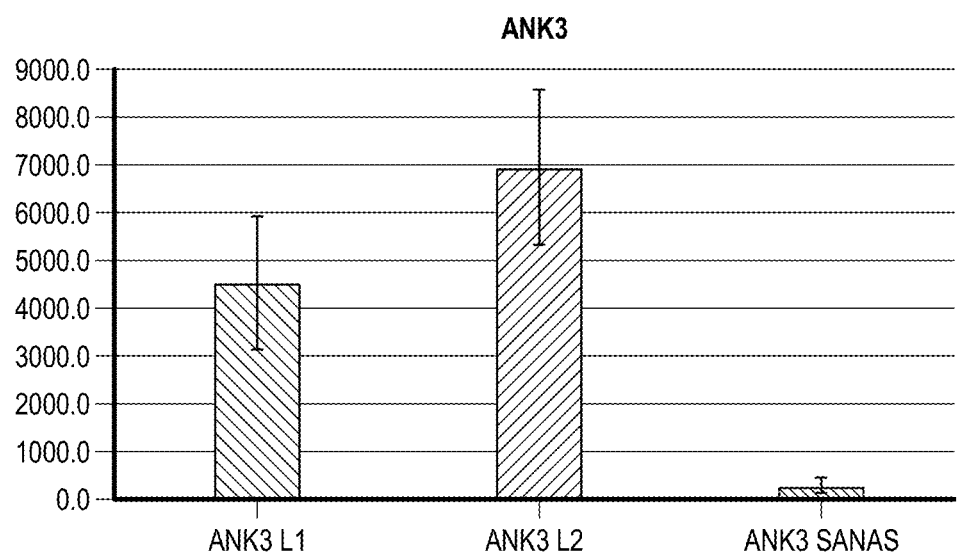
FIG. 9D illustrates the quantification of the data provided in FIG. 9A-9C.

As illustrated in FIGS. 9A-9C, it was demonstrated that Ankyrin-3 was detectable in the serum of patient having pre-cancerous cervical lesions L1 and L2, as compared to control sera. Specifically, it was found that Ankirin-3 expression was 10-times higher in the serum of patient with pre-cancerous lesions as compared to control (see FIG. 9D), demonstrating that pre-cancerous lesions, as well as cancerous (see example 2) can be detected in the serum of patient, by detecting the expression of Ankyrin-3 in the serum, which can be used as a biomarker for the detection of precancerous cervical lesions.

Similar results were obtained when the quantification of the proteins was intended by ELISA instead of by Western blot.

Example 4

Lateral Flow Assay for the Detection of Cervical Tumor and Precancerous Lesions For lateral flow assay, strip containing dried spot antibodies for test lines and positive lines were prepared, and samples collected from patients were tested for the detection of Farnesyl pyrophosphate synthase.

Blood samples collected from patients were either directly diluted in Chase buffer at a 1/5 dilution rate (for serum sample), or further absorbed onto blood separator pad (for whole blood sample) prior to being diluted in Chase buffer. 70 ul of diluted sample were used for each test.

The strip was assembled by removing the membrane section of the protective cover and apply CN-95 membrane. Two pieces of protective cover were removed from sections above where the nitrocellulose was placed. A 21 mm wick pad was then applied by aligning the top of the wick pad with the top of the backing card edge, and the excess backing card below the membrane, was cut off, leaving just the membrane and wick pad. The strips were cut to 5.0 mm width using Kinematic Guillotine and package in pouch with desiccant.

The test and positive lines were then prepared on the strip by spot drying antibodies. 1.0 μL of test line antibody was applied around 9 mm from the bottom of the nitrocellulose on 20 pre-cut test strips; and 1 μL of control line antibody was applied around 15 mm up from the bottom of the nitrocellulose on each pre-cut and spotted test strip. The strips were tapped down on piece of paper and place in 40 C oven for 1-hour. Once dried, the strips were packaged with desiccant. The antibodies were previously conjugated with gold (using colloidal gold) or biotinylated.

For the assay, each conjugate were diluted to 0.02% solids using 50 mM borate, 0.5% casein, 1% tween. 8 μL of conjugate were pipetted into glass tube, followed by 10 μL of serum. Half of the strip was place in glass tube, with bottom of nitro submerged in the testing solution to allow conjugate/serum solution to run up strip. 50 μL of 1×PBS, 1% tween 20 were then added to glass tube to chase sample.

Using the FLI assay described herein, it was demonstrated that Farnesyl pyrophosphate synthase expression level could be determined a liquid sample collected from a patient, such as the serum, and that therefore pre-cancerous lesions of low and high grade, as well as cancerous cervical lesions could be detected using the device.

Although the invention has been described with reference to the above examples, it will be understood that modifications and variations are encompassed within the spirit and scope of the invention. Accordingly, the invention is limited only by the following claims.

SEQUENCE LISTING (147 sequences)

SEQ ID NO: 1 - protein, 419 aa, Homo sapiens
  misc_feature: Farnesyl pyrophosphate synthase (FDPS)
MPLSRWLRSVGVFLLPAPYWAPRERWLGSLRRPSLVHGYPVLAWHSARCWCQAWTEEPRALCSSLRMNGDQNSDVYAQEKQDFVQHFSQIVRVLTEDEMGHPEIGDAIARLKEVLEYNAIGGKYNRGLTVVVAFRELVEPRKQDADSLQRAWTVGWCVELLQAFFLVADDIMDSSLTRRGQICWYQKPGVGLDAINDANLLEACIYRLLKLYCREQPYYLNLIELFLQSSYQTEIGQTLDLLTAPQGNVDLVRFTEKRYKSIVKYKTAFYSFYLPIAAAMYMAGIDGEKEHANAKKILLEMGEFFQIQDDYLDLFGDPSVTGKIGTDIQDNKCSWLVVQCLQRATPEQYQILKENYGQKEAEKVARVKALYEELDLPAVFLQYEEDSYSHIMALIEQYAAPLPPAVFLGLARKIYKRRK

SEQ ID NO: 2 - protein, 2839 aa, Homo sapiens
  misc_feature: Neurofibromin 1 (NF1)
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQATCHSLLNKATVKEKKENKKSVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPGIDKENVELSPTTGHCNSGRTRHGSASQVQKQRSAGSFKRNSIKKIV

SEQ ID NO: 3 - protein, 335 aa, Homo sapiens
  misc_feature: Glyceraldehyde-3 phosphate dehydrogenase (GAPDH)
MGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 4 - protein, 1894 aa, Homo sapiens
  misc_feature: Protein 1 containing fibronectin domain type III
  misc_feature: or Fibronectin Type III Domain Containing  protein 1 (FNDC1)
MAPEAGATLRAPRRLSWAALLLLAALLPVASSAAASVDHPLKPRHVKLLSTKMGLKVTWDPPKDATSRPVEHYNIAYGKSLKSLKYIKVNAETYSFLIEDVEPGVVYFVLLTAENHSGVSRPVYRAESPPGGEWIEIDGFPIKGPGPFNETVTEKEVPNKPLRVRVRSSDDRLSVAWKAPRLSGAKSPRRSRGFLLGYGESGRKMNYVPLTRDERTHEIKKLASESVYVVSLQSMNSQGRSQPVYRAALTKRKISEEDELDVPDDISVRVMSSQSVLVSWVDPVLEKQKKVVASRQYTVRYREKGELARWDYKQIANRRVLIENLIPDTVYEFAVRISQGERDGKWSTSVFQRTPESAPTTAPENLNVWPVNGKPTVVAASWDALPETEGKVKEYILSYAPALKPFGAKSLTYPGDTTSALVDGLQPGERYLFKIRATNRRGLGPHSKAFIVAMPTTSKADVEQNTEDNGKPEKPEPSSPSPRAPASSQHPSVPASPQGRNAKDLLLDLKNKILANGGAPRKPQLRAKKAEELDLQSTEITGEEELGSREDSPMSPSDTQDQKRTLRPPSRHGHSVVAPGRTAVRARMPALPRREGVDKPGFSLATQPRPGAPPSASASPAHHASTQGTSHRPSLPASLNDNDLVDSDEDERAVGSLHPKGAFAQPRPALSPSRQSPSSVLRDRSSVHPGAKPASPARRTPHSGAAEEDSSASAPPSRLSPPHGGSSRLLPTQPHLSSPLSKGGKDGEDAPATNSNAPSRSTMSSSVSSHLSSRTQVSEGAEASDGESHGDGDREDGGRQAEATAQTLRARPASGHFHLLRHKPFAANGRSPSRFSIGRGPRLQPSSSPQSTVPSRAHPRVPSHSDSHPKLSSGIHGDEEDEKPLPATVVNDHVPSSSRQPISRGWEDLRRSPQRGASLHRKEPIPENPKSTGADTHPQGKYSSLASKAQDVQQSTDADTEGHSPKAQPGSTDRHASPARPPAARSQQHPSVPRRMTPGRAPQQQPPPPVATSQHHPGPQSRDAGRSPSQPRLSLTQAGRPRPTSQGRSHSSSDPYTASSRGMLPTALQNQDEDAQGSYDDDSTEVEAQDVRAPAHAARAKEAAASLPKHQQVESPTGAGAGGDHRSQRGHAASPARPSRPGGPQSRARVPSRAAPGKSEPPSKRPLSSKSQQSVSAEDDEEEDAGFFKGGKEDLLSSSVPKWPSSSTPRGGKDADGSLAKEEREPAIALAPRGGSLAPVKRPLPPPPGSSPRASHVPSRLPPRSAATVSPVAGTHPWPQYTTRAPPGHFSTTPMLSLRQRMMHARFRNPLSRQPARPSYRQGYNGRPNVEGKVLPGSNGKPNGQRIINGPQGTKWVVDLDRGLVLNAEGRYLQDSHGNPLRIKLGGDGRTIVDLEGTPVVSPDGLPLFGQGRHGTPLANAQDKPILSLGGKPLVGLEVIKKTTHPPTTTMQPTTTTTPLPTTTTPRPTTATTRRTTTTRRTTTRRPTTTVRTTTRTTTTTTPTPTTPIPTCPPGTLERHDDDGNLIMSSNGIPECYAEEDEFSGLETDTAVPTEEAYVIYDEDYEFETSRPPTTTEPSTTATTPRVIPEEGAISSFPEEEFDLAGRKRFVAPYVTYLNKDPSAPCSLTDALDHFQVDSLDEIIPNDLKKSDLPPQHAPRNITVVAVEGCHSFVIVDWDKATPGDVVTGYLVYSASYEDFIRNKWSTQASSVTHLPIENLKPNTRYYFKVQAQNPHGYGPISPSVSFVTESDNPLLVVRPPGGEPIWIPFAFKHDPSYTDCHGRQYVKRTWYRKFVGVVLCNSLRYKIYLSDNLKDTFYSIGDSWGRGEDHCQFVDSHLDGRTGPQSYVEALPTIQGYYRQYRQEPVRFGNIGFGTPYYYVGWYECGVSIPGKW

SEQ ID NO: 5 - protein, 406 aa, Homo sapiens
  misc_feature: Eukaryotic initiation factor 4A-I (EIF4A1)
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHARDFTVSAMHGDMDQKERDVIMREFRSGSSRVLITTDLLARGIDVQQVSLVINYDLPTNRENYIHRIGRGGRFGRKGVAINMVTEEDKRTLRDIETFYNTSIEEMPLNVADLI

SEQ ID NO: 6 - protein, 334 aa, Homo sapiens
  misc_feature: L-lactate dehydrogenase chain B (LDHB)
MATLKEKLIAPVAEEEATVPNNKITVVGVGQVGMACAISILGKSLADELALVDVLEDKLKGEMMDLQHGSLFLQTPKIVADKDYSVTANSKIVVVTAGVRQQEGESRLNLVQRNVNVFKFIIPQIVKYSPDCIIIVVSNPVDILTYVTWKLSGLPKHRVIGSGCNLDSARFRYLMAEKLGIHPSSCHGWILGEHGDSSVAVWSGVNVAGVSLQELNPEMGTDNDSENWKEVHKMVVESAYEVIKLKGYTNWAIGLSVADLIESMLKNLSRIHPVSTMVKGMYGIENEVFLSLPCILNARGLTSVINQKLKDDEVAQLKKSADTLWDIQKDLKDL

SEQ ID NO: 7 - protein, 372 aa, Homo sapiens
  misc_feature: Nuclear heterogeneous Ribonucleoprotein A1 (HNRNPA1)
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGGYGGGGPGYSGGSRGYGSGGQGYGNQGSGYGGSGSYDSYNNGGGGGFGGGSGSNFGGGGSYNDFGNYNNQSSNFGPMKGGNFGGRSSGPYGGGGQYFAKPRNQGGYGGSSSSSSYGSGRRF

SEQ ID NO: 8 - protein, 2849 aa, Homo sapiens
  misc_feature: Polycystic kidney disease protein 1-like 1 (PKD1L1)
MAEEAAQNISDDQERCLQAACCLSFGGELSVSTDKSWGLHLCSCSPPGGGLWVEVYANHVLLMSDGKCGCPWCALNGKAEDRESQSPSSSASRQKNIWKTTSEAALSVVNEKTQAVVNEKTQAPLDCDNSADRIPHKPFIIIARAWSSGGPRFHHRRLCATGTADSTFSALLQLQGTTSAAAPCSLKMEASCCVLRLLCCAEDVATGLLPGTVTMETPTKVARPTQTSSQRVPLWPISHFPTSPRSSHGLPPGIPRTPSFTASQSGSEILYPPTQHPPVAILARNSDNFMNPVLNCSLEVEARAPPNLGFRVHMASGEALCLMMDFGDSSGVEMRLHNMSEAMAVTAYHQYSKGIFFHLLHFQLDMSTYKEAETQNTTLNVYLCQSENSCLEDSDPSNLGYELISAFVTKGVYMLKAVIYNEFHGTEVELGPYYVEIGHEAVSAFMNSSSVHEDEVLVFADSQVNQKSTVVIHHFPSIPSYNVSFISQTQVGDSQAWHSMTVWYKMQSVSVYTNGTVFATDTDITFTAVTKETIPLEFEWYFGEDPPVRTTSRSIKKRLSIPQWYRVMVKASNRMSSVVSEPHVIRVQKKIVANRLTSPSSALVNASVAFECWINFGTDVAYLWDFGDGTVSLGSSSSSHVYSREGEFTVEVLAFNNVSASTLRQQLFIVCEPCQPPLVKNMGPGKVQIWRSQPVRLGVTFEAAVFCDISQGLSYTWNLMDSEGLPVSLPAAVDTHRQTLILPSHTLEYGNYTALAKVQIEGSVVYSNYCVGLEVRAQAPVSVISEGTHLFFSRTTSSPIVLRGTQSFDPDDPGATLRYHWECATAGSPAHPCFDSSTAHQLDAAAPTVSFEAQWLSDSYDQFLVMLRVSSGGRNSSETRVFLSPYPDSAFRFVHISWVSFKDTFVNWNDELSLQAMCEDCSEIPNLSYSWDLFLVNATEKNRIEVPFCRVVGLLGSLGLGAISESSQLNLLPTEPGTADPDATTTPFSREPSPVTLGQPATSAPRGTPTEPMTGVYWIPPAGDSAVLGEAPEEGSLDLEPGPQSKGSLMTGRSERSQPTHSPDPHLSDFEAYYSDIQEAIPSGGRQPAKDTSFPGSGPSLSAEESPGDGDNLVDPSLSAGRAEPVLMIDWPKALLGRAVFQGYSSSGITEQTVTIKPYSLSSGETYVLQVSVASKHGLLGKAQLYLTVNPAPRDMACQVQPHHGLEAHTVFSVFCMSGKPDFHYEFSYQIGNTSKHTLYHGRDTQYYFVLPAGEHLDNYKVMVSTEITDGKGSKVQPCTVVVTVLPRYHGNDCLGEDLYNSSLKNLSTLQLMGSYTEIRNYITVITRILSRLSKEDKTASCNQWSRIQDALISSVCRLAFVDQEEMIGSVLMLRDLVSFSNKLGFMSAVLILKYTRALLAQGQFSGPFVIDKGVRLELIGLISRVWEVSEQENSKEEVYRHEEGITVISDLLLGCLSLNHVSTGQMEFRTLLHYNLQSSVQSLGSVQVHLPGDLAGHSPAGAETQSPCYISQLILFKKNPYPGSQAPGQIGGVVGLNLYTCSSRRPINRQWLRKPVMVEFGEEDGLDNRRNKTTFVLLRDKVNLHQFTELSENPQESLQIEIEFSKPVTRAFPVMLLVRFSEKPTPSDFLVKQIYFWDESIVQIYIPAASQKDASVGYLSLLDADYDRKPPNRYLAKAVNYTVHFQWIRCLFWDKREWKSERFSPQPGTSPEKVNCSYHRLAAFALLRRKLKASFEVSDISKLQSHPENLLPSIFIMGSVILYGFLVAKSRQVDHHEKKKAGYIFLQEASLPGHQLYAVVIDTGFRAPARLTSKVYIVLCGDNGLSETKELSCPEKPLFERNSRHTFILSAPAQLGLLRKIRLWHDSRGPSPGWFISHVMVKELHTGQGWFFPAQCWLSAGRHDGRVERELTCLQGGLGFRKLFYCKFTEYLEDFHVWLSVYSRPSSSRYLHTPRLTVSFSLLCVYACLTALVAAGGQEQPHLDVSPTLGSFRVGLLCTLLASPGAQLLSLLFRLSKEAPGSARVEPHSPLRGGAQTEAPHGPNSWGRIPDAQEPRKQPASAILSGSGRAQRKAASDNGTACPAPKLQVHGADHSRTSLMGKSHCCPPHTQAPSSGLEGLMPQWSRALQPWWSSAVWAICGTASLACSLGTGFLAYRFGQEQCVQWLHLLSLSVVCCIFITQPLMVCLMALGFAWKRRADNHFFTESLCEATRDLDSELAERSWTRLPFSSSCSIPDCAGEVEKVLAARQQARHLRWAHPPSKAQLRGTRQRMRRESRTRAALRDISMDILMLLLLLCVIYGRFSQDEYSLNQAIRKEFTRNARNCLGGLRNIADWWDWSLTTLLDGLYPGGTPSARVPGAQPGALGGKCYLIGSSVIRQLKVFPRHLCKPPRPFSALIEDSIPTCSPEVGGPENPYLIDPENQNVTLNGPGGCGTREDCVLSLGRTRTEAHTALSRLRASMWIDRSTRAVSVHFTLYNPPTQLFTSVSLRVEILPTGSLVPSSLVESFSIFRSDSALQYHLMLPQLVFLALSLIHLCVQLYRMMDKGVLSYWRKPRNWLELSVVGVSLTYYAVSGHLVTLAGDVTNQFHRGLCRAFMDLTLMASWNQRARWLRGILLFLFTLKCVYLPGIQNTMASCSSMMRHSLPSIFVAGLVGALMLAALSHLHRFLLSMWVLPPGTFTDAFPGLLFHFPRRSQKDCLLGLSKSDQRAMACYFGILLIVSATLCFGMLRGFLMTLPQKRKSFQSKSFVRLKDVTAYMWEKVLTFLRLETPKLEEAEMVENHNYYLDEFANLLDELLMKINGLSDSLQLPLLEKTSNNTGEARTEESPLVDISSYQAAEPADIKDF

SEQ ID NO: 9 - protein, 646 aa, Homo sapiens
  misc_feature: Cognate thermal shock protein 71 kDa
  misc_feature: or heat shock protein cognate 71 kDa (HSPA8)
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 10 - protein, 4377 aa, Homo sapiens
  misc_feature: Anikirina-3
  misc_feature: or Ankyrin-3 (ANK3)
MAHAASQLKKNRDLEINAEEEPEKKRKHRKRSRDRKKKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKETESDQDDEIEKTDRRQSFASLALRKRYSYLTEPGMIERSTGATRSLPTTYSYKPFFSTRPYQSWTTAPITVPGPAKSGFTSLSSSSSNTPSASPLKSIWSVSTPSPIKSTLGASTTSSVKSISDVASPIRSFRTMSSPIKTVVSQSPYNIQVSSGTLARAPAVTEATPLKGLASNSTFSSRTSPVTTAGSLLERSSITMTPPASPKSNINMYSSSLPFKSIITSAAPLISSPLKSVVSPVKSAVDVISSAKITMASSLSSPVKQMPGHAEVALVNGSISPLKYPSSSTLINGCKATATLQEKISSATNSVSSVVSAATDTVEKVFSTTTAMPFSPLRSYVSAAPSAFQSLRTPSASALYTSLGSSISATTSSVTSSIITVPVYSVVNVLPEPALKKLPDSNSFTKSAAALLSPIKTLTTETHPQPHFSRTSSPVKSSLFLAPSALKLSTPSSLSSSQEILKDVAEMKEDLMRMTAILQTDVPEEKPFQPELPKEGRIDDEEPFKIVEKVKEDLVKVSEILKKDVCVDNKGSPKSPKSDKGHSPEDDWIEFSSEEIREARQQAAASQSPSLPERVQVKAKAASEKDYNLTKVIDYLTNDIGSSSLTNLKYKFEDAKKDGEERQKRVLKPAIALQEHKLKMPPASMRTSTSEKELCKMADSFFGTDTILESPDDFSQHDQDKSPLSDSGFETRSEKTPSAPQSAESTGPKPLFHEVPIPPVITETRTEVVHVIRSYDPSAGDVPQTQPEEPVSPKPSPTFMELEPKPTTSSIKEKVKAFQMKASSEEDDHNRVLSKGMRVKEETHITTTTRMVYHSPPGGEGASERIEETMSVHDIMKAFQSGRDPSKELAGLFEHKSAVSPDVHKSAAETSAQHAEKDNQMKPKLERIIEVHIEKGNQAEPTEVIIRETKKHPEKEMYVYQKDLSRGDINLKDFLPEKHDAFPCSEEQGQQEEEELTAEESLPSYLESSRVNTPVSQEEDSRPSSAQLISDDSYKTLKLLSQHSIEYHDDELSELRGESYRFAEKMLLSEKLDVSHSDTEESVTDHAGPPSSELQGSDKRSREKIATAPKKEILSKIYKDVSENGVGKVSKDEHFDKVTVLHYSGNVSSPKHAMWMRFTEDRLDRGREKLIYEDRVDRTVKEAEEKLTEVSQFFRDKTEKLNDELQSPEKKARPKNGKEYSSQSPTSSSPEKVLLTELLASNDEWVKARQHGPDGQGFPKAEEKAPSLPSSPEKMVLSQQTEDSKSTVEAKGSISQSKAPDGPQSGFQLKQSKLSSIRLKFEQGTHAKSKDMSQEDRKSDGQSRIPVKKIQESKLPVYQVFAREKQQKAIDLPDESVSVQKDFMVLKTKDEHAQSNEIVVNDSGSDNVKKQRTEMSSKAMPDSFSEQQAKDLACHITSDLATRGPWDKKVFRTWESSGATNNKSQKEKLSHVLVHDVRENHIGHPESKSVDQKNEFMSVTERERKLLTNGSLSEIKEMTVKSPSKKVLYREYVVKEGDHPGGLLDQPSRRSESSAVSHIPVRVADERRMLSSNIPDGFCEQSAFPKHELSQKLSQSSMSKETVETQHFNSIEDEKVTYSEISKVSKHQSYVGLCPPLEETETSPTKSPDSLEFSPGKESPSSDVFDHSPIDGLEKLAPLAQTEGGKEIKTLPVYVSFVQVGKQYEKEIQQGGVKKIISQECKTVQETRGTFYTTRQQKQPPSPQGSPEDDTLEQVSFLDSSGKSPLTPETPSSEEVSYEFTSKTPDSLIAYIPGKPSPIPEVSEESEEEEQAKSTSLKQTTVEETAVEREMPNDVSKDSNQRPKNNRVAYIEFPPPPPLDADQIESDKKHHYLPEKEVDMIEVNLQDEHDKYQLAEPVIRVQPPSPVPPGADVSDSSDDESIYQPVPVKKYTFKLKEVDDEQKEKPKASAEKASNQKELESNGSGKDNEFGLGLDSPQNEIAQNGNNDQSITECSIATTAEFSHDTDATEIDSLDGYDLQDEDDGLTESDSKLPIQAMEIKKDIWNTEGILKPADRSFSQSKLEVIEEEGKVGPDEDKPPSKSSSSEKTPDKTDQKSGAQFFTLEGRHPDRSVFPDTYFSYKVDEEFATPFKTVATKGLDFDPWSNNRGDDEVFDSKSREDETKPFGLAVEDRSPATTPDTTPARTPTDESTPTSEPNPFPFHEGKMFEMTRSGAIDMSKRDFVEERLQFFQIGEHTSEGKSGDQGEGDKSMVTATPQPQSGDTTVETNLERNVETPTVEPNPSIPTSGECQEGTSSSGSLEKSAAATNTSKVDPKLRTPIKMGISASTMTMKKEGPGEITDKIEAVMTSCQGLENETITMISNTANSQMGVRPHEKHDFQKDNFNNNNNLDSSTIQTDNIMSNIVLTEHSAPTCTTEKDNPVKVSSGKKTGVLQGHCVRDKQKVLGEQQKTKELIGIRQKSKLPIKATSPKDTFPPNHMSNTKASKMKQVSQSEKTKALTTSSCVDVKSRIPVKNTHRDNIIAVRKACATQKQGQPEKGKAKQLPSKLPVKVRSTCVTTTTTTATTTTTTTTTTTTSCTVKVRKSQLKEVCKHSIEYFKGISGETLKLVDRLSEEEKKMQSELSDEEESTSRNTSLSETSRGGQPSVTTKSARDKKTEAAPLKSKSEKAGSEKRSSRRTGPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 11 - protein, 1491 aa, Homo sapiens
  misc_feature: Rho 23
  misc_feature: or Rho GTPase-activating protein 23 (ARHGAP23)
MNGVAFCLVGIPPRPEPRPPQLPLGPRDGCSPRRPFPWQGPRTLLLYKSPQDGFGFTLRHFIVYPPESAVHCSLKEEENGGRGGGPSPRYRLEPMDTIFVKNVKEDGPAHRAGLRTGDRLVKVNGESVIGKTYSQVIALIQNSDDTLELSIMPKDEDILQLAYSQDAYLKGNEPYSGEARSIPEPPPICYPRKTYAPPARASTRATMVPEPTSALPSDPRSPAAWSDPGLRVPPAARAHLDNSSLGMSQPRPSPGAFPHLSSEPRTPRAFPEPGSRVPPSRLECQQALSHWLSNQVPRRAGERRCPAMAPRARSASQDRLEEVAAPRPWPCSTSQDALSQLGQEGWHRARSDDYLSRATRSAEALGPGALVSPRFERCGWASQRSSARTPACPTRDLPGPQAPPPSGLQGLDDLGYIGYRSYSPSFQRRTGLLHALSFRDSPFGGLPTFNLAQSPASFPPEASEPPRVVRPEPSTRALEPPAEDRGDEVVLRQKPPTGRKVQLTPARQMNLGFGDESPEPEASGRGERLGRKVAPLATTEDSLASIPFIDEPTSPSIDLQAKHVPASAVVSSAMNSAPVLGTSPSSPTFTFTLGRHYSQDCSSIKAGRRSSYLLAITTERSKSCDDGLNTFRDEGRVLRRLPNRIPSLRMLRSFFTDGSLDSWGTSEDADAPSKRHSTSDLSDATFSDIRREGWLYYKQILTKKGKKAGSGLRQWKRVYAALRARSLSLSKERREPGPAAAGAAAAGAGEDEAAPVCIGSCLVDISYSETKRRHVFRLTTADFCEYLFQAEDRDDMLGWIRAIRENSRAEGEDPGCANQALISKKLNDYRKVSHSSGPKADSSPKGSRGLGGLKSEFLKQSAARGLRTQDLPAGSKDDSAAAPKTPWGINIIKKNKKAAPRAFGVRLEECQPATENQRVPLIVAACCRIVEARGLESTGIYRVPGNNAVVSSLQEQLNRGPGDINLQDERWQDLNVISSLLKSFFRKLPEPLFTDDKYNDFIEANRIEDARERMRTLRKLIRDLPGHYYETLKFLVGHLKTIADHSEKNKMEPRNLALVFGPTLVRTSEDNMTDMVTHMPDRYKIVETLIQHSDWFFSDEEDKGERTPVGDKEPQAVPNIEYLLPNIGRTVPPGDPGSDSTTCSSAKSKGSWAPKKEPYAREMLAISFISAVNRKRKKRREARGLGSSTDDDSEQEAHKPGAGATAPGTQERPQGPLPGAVAPEAPGRLSPPAAPEERPAADTRSIVSGYSTLSTMDRSVCSGASGRRAGAGDEADDERSELSHVETDTEGAAGAGPGGRLTRRPSFSSHHLMPCDTLARRRLARGRPDGEGAGRGGPRAPEPPGSASSSSQESLRPPAAALASRPSRMEALRLRLRGTADDMLAVRLRRPLSPETRRRRSSWRRHTVVVQSPLTDLNFNEWKELGGGGPPEPAGARAHSDNKDSGLSSLESTKARAPSSAASQPPAPGDTGSLQSQPPRRSAASRLHQCL

SEQ ID NO: 12 - protein, 520 aa, Homo sapiens
  misc_feature: Cytoskeletal Keratin 78 type II
  misc_feature: or Keratin, type II cytoskeletal 78 (KRT78)
MSLSPCRAQRGFSARSACSARSRGRSRGGFSSRGGFSSRSLNSFGGCLEGSRGSTWGSGGRLGVRFGEWSGGPGLSLCPPGGIQEVTINQNLLTPLKIEIDPQFQVVRTQETQEIRTLNNQFASFIDKVRFLEQQNKVLETKWHLLQQQGLSGSQQGLEPVFEACLDQLRKQLEQLQGERGALDAELKACRDQEEEYKSKYEEEAHRRATLENDFVVLKKDVDGVFLSKMELEGKLEALREYLYFLKHLNEEELGQLQTQASDTSVVLSMDNNRYLDFSSIITEVRARYEEIARSSKAEAEALYQTKYQELQVSAQLHGDRMQETKVQISQLHQEIQRLQSQTENLKKQNASLQAAITDAEQRGELALKDAQAKVDELEAALRMAKQNLARLLCEYQELTSTKLSLDVEIATYRRLLEGEECRMSGECTSQVTISSVGGSAVMSGGVGGGLGSTCGLGSGKGSPGSCCTSIVTGGSNIILGSGKDPVLDSCSVSGSSAGSSCHTILKKTVESSLKTSITY

SEQ ID NO: 13 - protein, 3177 aa, Homo sapiens
  misc_feature: Alpha-3 collagen chain (VI)
  misc_feature: or Collagen type VI, alpha 3 (COL6A3)
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 14 - protein, 263 aa, Homo sapiens
  misc_feature: Beta subunit of proteasome type-5
  misc_feature: or Proteasome subunit beta type-5 (PSMB5)
MALASVLERPLPVNQRGFFGLGGRADLLDLGPGSLSDGLSLAAPGWGVPEEPGIEMLHGTTTLAFKFRHGVIVAADSRATAGAYIASQTVKKVIEINPYLLGTMAGGAADCSFWERLLARQCRIYELRNKERISVAAASKLLANMVYQYKGMGLSMGTMICGWDKRGPGLYYVDSEGNRISGATFSVGSGSVYAYGVMDRGYSYDLEVEQAYDLARRAIYQATYRDAYSGGAVNLYHVREDGWIRVSSDNVADLHEKYSGSTP

SEQ ID NO: 15 - protein, 353 aa, Homo sapiens
  misc_feature: Heterogeneous nuclear ribonucleoproteins A2/B1 (HNRNPA2B1)
MEKTLETVPLERKKREKEQFRKLFIGGLSFETTEESLRNYYEQWGKLTDCVVMRDPASKRSRGFGFVTFSSMAEVDAAMAARPHSIDGRVVEPKRAVAREESGKPGAHVTVKKLFVGGIKEDTEEHHLRDYFEEYGKIDTIEIITDRQSGKKRGFGFVTFDDHDPVDKIVLQKYHTINGHNAEVRKALSRQEMQEVQSSRSGRGGNFGFGDSRGGGGNFGPGPGSNFRGGSDGYGSGRGFGDGYNGYGGGPGGGNFGGSPGYGGGRGGYGGGGPGYGNQGGGYGGGYDNYGGGNYGSGNYNDFGNYNQQPSNYGPMKSGNFGGSRNMGGPYGGGNYGPGGSGGSGGYGGRSRY

SEQ ID NO: 16 - protein, 126 aa, Homo sapiens
  misc_feature: Histone H2B type 1-B (HIST1H2BB)
MPEPSKSAPAPKKGSKKAITKAQKKDGKKRKRSRKESYSIYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 17 - protein, 2243 aa, Homo sapiens
  misc_feature: homolog of DnaJ subfamily C member 13
  misc_feature: or DnaJ homolog subfamily C member 13 (DNAJC13)
MNIIRENKDLACFYTTKHSWRGKYKRVFSVGTHAITTYNPNTLEVTNQWPYGDICSISPVGKGQGTEFNLTFRKGSGKKSETLKFSTEHRTELLTEALRFRTDFSEGKITGRRYNCYKHHWSDSRKPVILEVTPGGFDQINPATNRVLCSYDYRNIEGFVDLSDYQGGFCILYGGFSRLHLFASEQREEIIKSAIDHAGNYIGISLRIRKEPLEFEQYLNLRFGKYSTDESITSLAEFVVQKISPRHSEPVKRVLALTETCLVERDPATYNIATLKPLGEVFALVCDSENPQLFTIEFIKGQVRKYSSTERDSLLASLLDGVRASGNRDVCVKMTPTHKGQRWGLLSMPVDEEVESLHLRFLATPPNGNFADAVFRFNANISYSGVLHAVTQDGLFSENKEKLINNAITALLSQEGDVVASNAELESQFQAVRRLVASKAGFLAFTQLPKFRERLGVKVVKALKRSNNGIIHAAVDMLCALMCPMHDDYDLRQEQLNKASLLSSKKFLENLLEKFNSHVDHGTGALVISSLLDFLTFALCAPYSETTEGQQFDMLLEMVASNGRTLFKLFQHPSMAIIKGAGLVMKAIIEEGDKEIATKMQELALSEGALPRHLHTAMFTISSDQRMLTNRQLSRHLVGLWTADNATATNLLKRILPPGLLAYLESSDLVPEKDADRMHVRDNVKIAMDQYGKFNKVPEWQRLAGKAAKEVEKFAKEKVDLVLMHWRDRMGIAQKENINQKPVVLRKRRQRIKIEANWDLFYYRFGQDHARSNLIWNFKTREELKDTLESEMRAFNIDRELGSANVISWNHHEFEVKYECLAEEIKIGDYYLRLLLEEDENEESGSIKRSYEFFNELYHRFLLTPKVNMKCLCLQALAIVYGRCHEEIGPFTDTRYIIGMLERCTDKLERDRLILFLNKLILNKKNVKDLMDSNGIRILVDLLTLAHLHVSRATVPLQSNVIEAAPDMKRESEKEWYFGNADKERSGPYGFHEMQELWTKGMLNAKTRCWAQGMDGWRPLQSIPQLKWCLLASGQAVLNETDLATLILNMLITMCGYFPSRDQDNAIIRPLPKVKRLLSDSTCLPHIIQLLLTFDPILVEKVAILLYHIMQDNPQLPRLYLSGVFFFIMMYTGSNVLPVARFLKYTHTKQAFKSEETKGQDIFQRSILGHILPEAMVCYLENYEPEKFSEIFLGEFDTPEAIWSSEMRRLMIEKIAAHLADFTPRLQSNTRALYQYCPIPIINYPQLENELFCNIYYLKQLCDTLRFPDWPIKDPVKLLKDTLDAWKKEVEKKPPMMSIDDAYEVLNLPQGQGPHDESKIRKAYFRLAQKYHPDKNPEGRDMFEKVNKAYEFLCTKSAKIVDGPDPENIILILKTQSILFNRHKEDLQPYKYAGYPMLIRTITMETSDDLLFSKESPLLPAATELAFHTVNCSALNAEELRRENGLEVLQEAFSRCVAVLTRASKPSDMSVQVCGYISKCYSVAAQFEECREKITEMPSIIKDLCRVLYFGKSIPRVAALGVECVSSFAVDFWLQTHLFQAGILWYLLGFLFNYDYTLEESGIQKSEETNQQEVANSLAKLSVHALSRLGGYLAEEQATPENPTIRKSLAGMLTPYVARKLAVASVTEILKMLNSNTESPYLIWNNSTRAELLEFLESQQENMIKKGDCDKTYGSEFVYSDHAKELIVGEIFVRVYNEVPTFQLEVPKAFAASLLDYIGSQAQYLHTFMAITHAAKVESEQHGDRLPRVEMALEALRNVIKYNPGSESECIGHFKLIFSLLRVHGAGQVQQLALEVVNIVTSNQDCVNNIAESMVLSSLLALLHSLPSSRQLVLETLYALTSSTKIIKEAMAKGALIYLLDMFCNSTHPQVRAQTAELFAKMTADKLIGPKVRITLMKFLPSVFMDAMRDNPEAAVHIFEGTHENPELIWNDNSRDKVSTTVREMMLEHFKNQQDNPEANWKLPEDFAVVFGEAEGELAVGGVFLRIFIAQPAWVLRKPREFLIALLEKLTELLEKNNPHGETLETLTMATVCLFSAQPQLADQVPPLGHLPKVIQAMNHRNNAIPKSAIRVIHALSENELCVRAMASLETIGPLMNGMKKRADTVGLACEAINRMFQKEQSELVAQALKADLVPYLLKLLEGIGLENLDSPAATKAQIVKALKAMTRSLQYGEQVNEILCRSSVWSAFKDQKHDLFISESQTAGYLTGPGVAGYLTAGTSTSVMSNLPPPVDHEAGDLGYQT

SEQ ID NO: 18 - protein, 434 aa, Homo sapiens
  misc_feature: Beta enolase (ENO3)
MAMQKIFAREILDSRGNPTVEVDLHTAKGRFRAAVPSGASTGIYEALELRDGDKGRYLGKGVLKAVENINNTLGPALLQKKLSVVDQEKVDKFMIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGELYKSFIKNYPVVSIEDPFDQDDWATWTSFLSGVNIQIVGDDLTVTNPKRIAQAVEKKACNCLLLKVNQIGSVTESIQACKLAQSNGWGVMVSHRSGETEDTFIADLVVGLCTGQIKTGAPCRSERLAKYNQLMRIEEALGDKAIFAGRKFRNPKAK

SEQ ID NO: 19 - protein, 210 aa, Homo sapiens
  misc_feature: Glutathione S-transferase P (GSTP1)
MPPYTVVYFPVRGRCAALRMLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQISFADYNLLDLLLIHEVLAPGCLDAFPLLSAYVGRLSARPKLKAFLASPEYVNLPINGNGKQ

SEQ ID NO: 20 - protein, 225 aa, Homo sapiens
  misc_feature: Glutathione S-transferase Mu 3 (GSTM3)
MSCESSMVLGYWDIRGLAHAIRLLLEFTDTSYEEKRYTCGEAPDYDRSQWLDVKFKLDLDFPNLPYLLDGKNKITQSNAILRYIARKHNMCGETEEEKIRVDIIENQVMDFRTQLIRLCYSSDHEKLKPQYLEELPGQLKQFSMFLGKFSWFAGEKLTFVDFLTYDILDQNRIFDPKCLDEFPNLKAFMCRFEALEKIAAYLQSDQFCKMPINNKMAQWGNKPVC

SEQ ID NO: 21 - protein, 419 aa, Homo sapiens; identical to SEQ ID NO: 1
  misc_feature: Farnesyl pyrophosphate synthase Variant 2

SEQ ID NO: 22 - protein, 353 aa, Homo sapiens
  misc_feature: Farnesyl pyrophosphate synthase Variant 3
MNGDQNSDVYAQEKQDFVQHFSQIVRVLTEDEMGHPEIGDAIARLKEVLEYNAIGGKYNRGLTVVVAFRELVEPRKQDADSLQRAWTVGWCVELLQAFFLVADDIMDSSLTRRGQICWYQKPGVGLDAINDANLLEACIYRLLKLYCREQPYYLNLIELFLQSSYQTEIGQTLDLLTAPQGNVDLVRFTEKRYKSIVKYKTAFYSFYLPIAAAMYMAGIDGEKEHANAKKILLEMGEFFQIQDDYLDLFGDPSVTGKIGTDIQDNKCSWLVVQCLQRATPEQYQILKENYGQKEAEKVARVKALYEELDLPAVFLQYEEDSYSHIMALIEQYAAPLPPAVFLGLARKIYKRRK

SEQ ID NO: 23 - protein, 353 aa, Homo sapiens; identical to SEQ ID NO: 22

SEQ ID NO: 24 - protein, 248 aa, Homo sapiens
  misc_feature: Farnesyl pyrophosphate synthase Variant 5
MDSSLTRRGQICWYQKPGVGLDAINDANLLEACIYRLLKLYCREQPYYLNLIELFLQSSYQTEIGQTLDLLTAPQGNVDLVRFTEKRYKSIVKYKTAFYSFYLPIAAAMYMAGIDGEKEHANAKKILLEMGEFFQIQDDYLDLFGDPSVTGKIGTDIQDNKCSWLVVQCLQRATPEQYQILKENYGQKEAEKVARVKALYEELDLPAVFLQYEEDSYSHIMALIEQYAAPLPPAVFLGLARKIYKRRK

SEQ ID NO: 25 - protein, 353 aa, Homo sapiens; identical to SEQ ID NO: 22
  misc_feature: Farnesyl pyrophosphate synthase Variant 6

SEQ ID NO: 26 - protein, 274 aa, Homo sapiens
  misc_feature: Farnesyl pyrophosphate synthase Variant 7
MPLSRWLRSVGVFLLPAPYWAPRERWLGSLRRPSLVHGYPVLAWHSARCWCQAWTEEPRALCSSLRMNGDQNSDVYAQEKQDFVQHFSQIVRVLTEDEMGHPEIGDAIARLKEVLEYNAIGGKYNRGLTVVVAFRELVEPRKQDADSLQRAWTVGWCVELLQAFFLVADDIMDSSLTRRGQICWYQKPGVGLDAINDANLLEACIYRLLKLYCREQPYYLNLIELFLQSSYQTEIGQTLDLLTAPQGNVDLVRFTEKRYKSIVKYKTAFYSFYL

SEQ ID NO: 27 - protein, 174 aa, Homo sapiens
  misc_feature: Farnesyl pyrophosphate synthase Variant 8
MPLSRWLRSVGVFLLPAPYWAPRERWLGSLRRPSLVHGYPVLAWHSARCWCQAWTEEPRALCSSLRMNGDQNSDVYAQEKQDFVQHFSQIVRVLTEDEMGHPEIGDAIARLKEVLEYNAIGGKYNRGLTVVVAFRELVEPRKQDADSLQRAWTVGWCVELLQAFFLVADDIMDS

SEQ ID NO: 28 - protein, 2818 aa, Homo sapiens
  misc_feature: Neurofibromin 1 Variant 2
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPGIDKENVELSPTTGHCNSGRTRHGSASQVQKQRSAGSFKRNSIKKIV

SEQ ID NO: 29 - protein, 593 aa, Homo sapiens
  misc_feature: Neurofibromin 1 Variant 3
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEIRYMYFYFLNSTFKFYFVFLS

SEQ ID NO: 30 - protein, 2502 aa, Homo sapiens
  misc_feature: Neurofibromin 1 Variant 4
NWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPASLPCSKSAVFMQLFPHQGIDKENVELSPTTGHCNSGRTRHGSASQVQKQRSAGSFKRNSIKKIV

SEQ ID NO: 31 - protein, 551 aa, Homo sapiens
  misc_feature: Neurofibromin 1 Variant 5
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEVRGK

SEQ ID NO: 32 - protein, 237 aa, Homo sapiens
  misc_feature: Neurofibromin 1 Variant 6
MHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSK

SEQ ID NO: 33 - protein, 233 aa, Homo sapiens
  misc_feature: Neurofibromin 1 Variant 6
MKRCWSNSCCQKSAIFFTPVVKETSMQLNFGILPLGFYFLSAATTSMQSLVAFLPETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKVRRAKLFPLYLDVKQFILLKVCITLGLLFKQSISGNHLNDHFRFLCLMDLEETYSYIILFGRGKIIPGNEQRFKIIP

SEQ ID NO: 34 - protein, 115 aa, Homo sapiens
  misc_feature: Neurofibromin 1 Variant 8
  misc_feature (1)..(1): Xaa can be any naturally occurring amino acid
XIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPGQ

SEQ ID NO: 35 - protein, 293 aa, Homo sapiens
  misc_feature: Glyceraldehyde-3 phosphate dehydrogenase Variant 2
MVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 36 - protein, 335 aa, Homo sapiens; identical to SEQ ID NO: 3
  misc_feature: Glyceraldehyde-3 phosphate dehydrogenase Variant 3

SEQ ID NO: 37 - protein, 335 aa, Homo sapiens; identical to SEQ ID NO: 3
  misc_feature: Glyceraldehyde-3 phosphate dehydrogenase Variant 4

SEQ ID NO: 38 - protein, 260 aa, Homo sapiens
  misc_feature: Glyceraldehyde-3 phosphate dehydrogenase Variant 5
MEEMRDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 39 - protein, 293 aa, Homo sapiens; identical to SEQ ID NO: 35
  misc_feature: Glyceraldehyde-3 phosphate dehydrogenase Variant 6

SEQ ID NO: 40 - protein, 1790 aa, Homo sapiens
  misc_feature: Fibronectin Type III Domain Containing  protein 1 Variant 2
  misc_feature (1)..(1): Xaa can be any naturally occurring amino acid
XPRHVKLLSTKMGLKVTWDPPKDATSRPVEHYNIAYGKSLKSLKYIKVNAETYSFLIEDVEPGVVYFVLLTAENHSGVSRPVYRAESPPGGEWIEIDGFPIKGPGPFNETVTEKEVPNKPLRVRVRSSDDRLSVAWKAPRLSGAKSPRRSRGFLLGYGESGRKMNYVPLTRDERTHEIKKLASESVYVVSLQSMNSQGRSQPVYRAALTKRKISEEDELDVPDDISVRVMSSQSVLVSWVDPVLEKQKKVVASRQYTVRYREKGELARWDYKQIANRRVLIENLIPDTVYEFAVRISQGERDGKWSTSVFQRTPESAPTTAPENLNVWPVNGKPTVVAASWDALPETEGKVKASKADVEQNTEDNGKPEKPEPSSPSPRAPASSQHPSVPASPQGRNAKDLLLDLKNKILANGGAPRKPQLRAKKAEELDLQSTEITGEEELGSREDSPMSPSDTQDQKRTLRPPSRHGHSVVAPGRTAVRARMPALPRREGVDKPGFSLATQPRPGAPPSASASPAHHASTQGTSHRPSLPASLNDNDLVDSDEDERAVGSLHPKGAFAQPRPALSPSRQSPSSVLRDRSSVHPGAKPASPARRTPHSGAAEEDSSASAPPSRLSPPHGGSSRLLPTQPHLSSPLSKGGKDGEDAPATNSNAPSRSTMSSSVSSHLSSRTQVSEGAEASDGESHGDGDREDGGRQAEATAQTLRARPASGHFHLLRHKPFAANGRSPSRFSIGRGPRLQPSSSPQSTVPSRAHPRVPSHSDSHPKLSSGIHGDEEDEKPLPATVVNDHVPSSSRQPISRGWEDLRRSPQRGASLHRKEPIPENPKSTGADTHPQGKYSSLASKAQDVQQSTDADTEGHSPKAQPGSTDRHASPARPPAARSQQHPSVPRRMTPGRAPQQQPPPPVATSQHHPGPQSRDAGRSPSQPRLSLTQAGRPRPTSQGRSHSSSDPYTASSRGMLPTALQNQDEDAQGSYDDDSTEVEAQDVRAPAHAARAKEAAASLPKHQQVESPTGAGAGGDHRSQRGHAASPARPSRPGGPQSRARVPSRAAPGKSEPPSKRPLSSKSQQSVSAEDDEEEDAGFFKGGKEDLLSSSVPKWPSSSTPRGGKDADGSLAKEEREPAIALAPRGGSLAPVKRPLPPPPGSSPRASHVPSRLPPRSAATVSPVAGTHPWPQYTTRAPPGHFSTTPMLSLRQRMMHARFRNPLSRQPARPSYRQGYNGRPNVEGKVLPGSNGKPNGQRIINGPQGTKWVVDLDRGLVLNAEGRYLQDSHGNPLRIKLGGDGRTIVDLEGTPVVSPDGLPLFGQGRHGTPLANAQDKPILSLGGKPLVGLEVIKKTTHPPTTTMQPTTTTTPLPTTTTPRPTTATTRRTTTTRRTTTRRPTTTVRTTTRTTTTTTPTPTTPIPTCPPGTLERHDDDGNLIMSSNGIPECYAEEDEFSGLETDTAVPTEEAYVIYDEDYEFETSRPPTTTEPSTTATTPRVIPEEGAISSFPEEEFDLAGRKRFVAPYVTYLNKDPSAPCSLTDALDHFQVDSLDEIIPNDLKKSDLPPQHAPRNITVVAVEGCHSFVIVDWDKATPGDVVTGYLVYSASYEDFIRNKWSTQASSVTHLPIENLKPNTRYYFKVQAQNPHGYGPISPSVSFVTESDNPLLVVRPPGGEPIWIPFAFKHDPSYTDCHGRQYVKRTWYRKFVGVVLCNSLRYKIYLSDNLKDTFYSIGDSWGRGEDHCQFVDSHLDGRTGPQSYVEALPTIQGYYRQYRQEPVRFGNIGFGTPYYYVGWYECGVSIPGKW

SEQ ID NO: 41 - protein, 347 aa, Homo sapiens
  misc_feature: Eukaryotic initiation factor 4A-I Variant 2
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHARDFTVSAMHGDMDQKERDVIMREFRSGSSRVLITTDLLGKLYPQNRSRWTVWP

SEQ ID NO: 42 - protein, 341 aa, Homo sapiens
  misc_feature: Eukaryotic initiation factor 4A-I Variant 3
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHARDFTVSAMHGDMDQKERDVIMREFRSGSSRVLITTDLLNRSRWTVWP

SEQ ID NO: 43 - protein, 257 aa, Homo sapiens
  misc_feature: Eukaryotic initiation factor 4A-I Variant 4
MEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTIT

SEQ ID NO: 44 - protein, 230 aa, Homo sapiens
  misc_feature: Eukaryotic initiation factor 4A-I Variant 5
  misc_feature (1)..(1): Xaa can be any naturally occurring amino acid
XVVMALGDYMGASCHACIGGTNVRAEVQKLQMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHARDFTVSAMHGDMDQKERDVIMREFRSGSSRVLITTDLLGKLYPQNRSRWTVWP

SEQ ID NO: 45 - protein, 300 aa, Homo sapiens
  misc_feature: Eukaryotic initiation factor 4A-I Variant 6
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQKVVMALGDYMGASCHACIGGTNVRAEVQKLQMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHARDFTVSAM

SEQ ID NO: 46 - protein, 271 aa, Homo sapiens
  misc_feature: Eukaryotic initiation factor 4A-I Variant 7
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDIFQKLNSNTQEELTLEGIRQFYINVEREEWKLDTLCDLYETLTITQAVIFINTRRKVDWLTEKMHARDFTVSA

SEQ ID NO: 47 - protein, 85 aa, Homo sapiens
  misc_feature: Eukaryotic initiation factor 4A-I Variant 7
MEPEGVIESNWNEIVDSFDDMNLSESLLRGIYAYGFEKPSAIQQRAILPCIKGYDVIAQAQSGTGKTATFAISILQQIELDLKAT

SEQ ID NO: 48 - protein, 214 aa, Homo sapiens
  misc_feature: Eukaryotic initiation factor 4A-I Variant 9
  misc_feature (1)..(1): Xaa can be any naturally occurring amino acid
XAWAHCARGRHRPRPPTSGSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDIFQKL

SEQ ID NO: 49 - protein, 187 aa, Homo sapiens
  misc_feature: Eukaryotic initiation factor 4A-I Variant 10
MSASQDSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLS

SEQ ID NO: 50 - protein, 163 aa, Homo sapiens
  misc_feature: Eukaryotic initiation factor 4A-I Variant 11
MNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDI

SEQ ID NO: 51 - protein, 134 aa, Homo sapiens
  misc_feature: Eukaryotic initiation factor 4A-I Variant 12
MNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRY

SEQ ID NO: 52 - protein, 117 aa, Homo sapiens
  misc_feature: Eukaryotic initiation factor 4A-I Variant 13
MFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHA

SEQ ID NO: 53 - protein, 85 aa, Homo sapiens
  misc_feature: Eukaryotic initiation factor 4A-I Variant 14
MGRSTFLRGSRDNGPDGMEPEGVIESNWNEIVDSFDDMNLSESLLRGIYAYGFEKPSAIQQRAILPCIKGYDVIAQAQSGTGKTA

SEQ ID NO: 54 - protein, 334 aa, Homo sapiens; identical to SEQ ID NO: 6
  misc_feature: L-lactate dehydrogenase chain B Variant 2

SEQ ID NO: 55 - protein, 341 aa, Homo sapiens
  misc_feature: L-lactate dehydrogenase chain B Variant 3
  misc_feature (335)..(335): Xaa can be any naturally occurring amino acid
MATLKEKLIAPVAEEEATVPNNKITVVGVGQVGMACAISILGKSLADELALVDVLEDKLKGEMMDLQHGSLFLQTPKIVADKDYSVTANSKIVVVTAGVRQQEGESRLNLVQRNVNVFKFIIPQIVKYSPDCIIIVVSNPVDILTYVTWKLSGLPKHRVIGSGCNLDSARFRYLMAEKLGIHPSSCHGWILGEHGDSSVAVWSGVNVAGVSLQELNPEMGTDNDSENWKEVHKMVVESAYEVIKLKGYTNWAIGLSVADLIESMLKNLSRIHPVSTMVKGMYGIENEVFLSLPCILNARGLTSVINQKLKDDEVAQLKKSADTLWDIQKDLKDLXLVSSRL

SEQ ID NO: 56 - protein, 232 aa, Homo sapiens
  misc_feature: L-lactate dehydrogenase chain B Variant 4
MATLKEKLIAPVAEEEATVPNNKITVVGVGQVGMACAISILGKSLADELALVDVLEDKLKGEMMDLQHGSLFLQTPKIVADKDYSVTANSKIVVVTAGVRQQEGESRLNLVQRNVNVFKFIIPQIVKYSPDCIIIVVSNPVDILTYVTWKLSGLPKHRVIGSGCNLDSARFRYLMAEKLGIHPSSCHGWILGEHGDSSVAVWSGVNVAGVSLQELNPEMGTDNDSENWKEVH

SEQ ID NO: 57 - protein, 136 aa, Homo sapiens
  misc_feature: L-lactate dehydrogenase chain B Variant 5
MATLKEKLIAPVAEEEATVPNNKITVVGVGQVGMACAISILGKSLADELALVDVLEDKLKGEMMDLQHGSLFLQTPKIVADKDYSVTANSKIVVVTAGVRQQEGESRLNLVQRNVNVFKFIIPQIVKYSPDCIIIV

SEQ ID NO: 58 - protein, 102 aa, Homo sapiens
  misc_feature: L-lactate dehydrogenase chain B Variant 6
MATLKEKLIAPVAEEEATVPNNKITVVGVGQVGMACAISILGKSLADELALVDVLEDKLKGEMMDLQHGSLFLQTPKIVADKDYSVTANSKIVVVTAGVRQQ

SEQ ID NO: 59 - protein, 320 aa, Homo sapiens
  misc_feature: Nuclear heterogeneous Ribonucleoprotein A1 Variant
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGSNFGGGGSYNDFGNYNNQSSNFGPMKGGNFGGRSSGPYGGGGQYFAKPRNQGGYGGSSSSSSYGSGRRF

SEQ ID NO: 60 - protein, 267 aa, Homo sapiens
  misc_feature: Nuclear heterogeneous Ribonucleoprotein A1 Variant 3
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGSYNDFGNYNNQSSNFGPMKGGNFGGRSSGPYGGGGQYFAKPRNQGGYGGSSSSSSYGSGRRF

SEQ ID NO: 61 - protein, 307 aa, Homo sapiens
  misc_feature: Nuclear heterogeneous Ribonucleoprotein A1 Variant 4
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGIGDGYNGFGNDGSNFGGGGSYNDFGNYNNQSSNFGPMKGGNFGGRSSGPYGGGGQYFAKPRNQGGYGGSSSSSSYGSGRRF

SEQ ID NO: 62 - protein, 191 aa, Homo sapiens
  misc_feature: Nuclear heterogeneous Ribonucleoprotein A1 Variant 5
KIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGSNFGGGGSYNDFGNYNNQSSNFGPMKGGNFGGRSSGPYGGGGQYFAKPRNQGGYGGSSSSSSYGSGRRF

SEQ ID NO: 63 - protein, 231 aa, Homo sapiens
  misc_feature: Nuclear heterogeneous Ribonucleoprotein A1 Variant 7
MRDSLLVAKFLGTQDLCLFLNLALSPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGG

SEQ ID NO: 64 - protein, 113 aa, Homo sapiens
  misc_feature: Nuclear heterogeneous Ribonucleoprotein A1 Variant 7
MRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDS

SEQ ID NO: 65 - protein, 156 aa, Homo sapiens
  misc_feature: Nuclear heterogeneous Ribonucleoprotein A1 Variant 8
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGFGGSRGGGGYGGSGDGYNGFGNDGSNFGGGGSYNDFGNYNNQSSN

SEQ ID NO: 66 - protein, 145 aa, Homo sapiens
  misc_feature: Nuclear heterogeneous Ribonucleoprotein A1 Variant 9
MSKSESPKEPEQLRKLFIGGLSFETTDESLRSHFEQWGTLTDCVDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQR

SEQ ID NO: 67 - protein, 436 aa, Homo sapiens
  misc_feature: Polycystic kidney disease protein 1-like 1 Variant 2
  misc_feature (1)..(1): Xaa can be any naturally occurring amino acid
XSRLRASMWIDRSTRAVSVHFTLYNPPTQLFTSVSLRVEILPTGSLVPSSLVESFSIFRSDSALQYHLMLPQLVFLALSLIHLCVQLYRMMDKGVLSYWRKPRNWLELSVVGVSLTYYAVSGHLVTLAGDVTNQFHRGLCRAFMDLTLMASWNQRARWLRGILLFLFTLKCVYLPGIQNTMASCSSMMRHSLPSIFVAGLVGALMLAALSHLHRFLLSMWVLPPGTFTDAFPGLLFHFPRRSQKDCLLGLSKSDQRAMACYFGILLIVSATLCFGMLRGFLMTLPQKRKSFQSKSFVRLKDVTAYMWEKVLTFLRLETPKLEEAEMVENHNYYLDEFANLLDELLMKINGLSDSLQLPLLEKTSNNTGEARTEESPLVDISSYQAAESLTLVTQTEVQWHDLGSLQPPHPRFKQFSCLSLPSSWDYRRVPLCLANF

SEQ ID NO: 68 - protein, 164 aa, Homo sapiens
  misc_feature: Polycystic kidney disease protein 1-like 1 Variant 3
  misc_feature (1)..(1): Xaa can be any naturally occurring amino acid
XVGGPENPYLIDPENQNVTLNGPGGCGTREDCVLSLGRTRTEAHTALSRLRASMWIDRSTRAVSVHFTLYNPPTQLFTSVSLRVEILPTGSLVPSSLVESFSIFRSDSALQYHLMLPQLVFLALSLIHLCVQLYRMMDKGVLSYWRKPRNWLEVASLVSFSFEK

SEQ ID NO: 69 - protein, 646 aa, Homo sapiens; identical to SEQ ID NO: 9
  misc_feature: Heat shock protein cognate 71 kDa  Variant 2

SEQ ID NO: 70 - protein, 646 aa, Homo sapiens; identical to SEQ ID NO: 9
  misc_feature: Heat shock protein cognate 71 kDa  Variant 3

SEQ ID NO: 71 - protein, 493 aa, Homo sapiens
  misc_feature: Heat shock protein cognate 71 kDa Variant 4
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGMPGGMPGGFPGGGAPPSGGASSGPTIEEVD

SEQ ID NO: 72 - protein, 627 aa, Homo sapiens
  misc_feature: Heat shock protein cognate 71 kDa  Variant 5
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 73 - protein, 410 aa, Homo sapiens
  misc_feature: Heat shock protein cognate 71 kDa Variant 6
MVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 74 - protein, 500 aa, Homo sapiens
  misc_feature: Heat shock protein cognate 71 kDa  Variant 7
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 75 - protein, 312 aa, Homo sapiens
  misc_feature: Heat shock protein cognate 71 kDa  Variant 8
MNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYG

SEQ ID NO: 76 - protein, 187 aa, Homo sapiens
  misc_feature: Heat shock protein cognate 71 kDa  Variant 9
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDK

SEQ ID NO: 77 - protein, 223 aa, Homo sapiens
  misc_feature: Heat shock protein cognate 71 kDa  Variant 10
MTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPP

SEQ ID NO: 78 - protein, 150 aa, Homo sapiens
  misc_feature: Heat shock protein cognate 71 kDa  Variant 11
MTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKE

SEQ ID NO: 79 - protein, 171 aa, Homo sapiens
  misc_feature: Heat shock protein cognate 71 kDa  Variant 12
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLR

SEQ ID NO: 80 - protein, 132 aa, Homo sapiens
  misc_feature: Heat shock protein cognate 71 kDa  Variant 13
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAE

SEQ ID NO: 81 - protein, 183 aa, Homo sapiens
  misc_feature: Heat shock protein cognate 71 kDa  Variant 14
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAY

SEQ ID NO: 82 - protein, 168 aa, Homo sapiens
  misc_feature: Heat shock protein cognate 71 kDa Variant 15
MSKGPAVGIDLGTTYSCVGVFQHGKVEIIANDQGNRTTPSYVAFTDTERLIGDAAKNQVAMNPTNTVFETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSI

SEQ ID NO: 83 - protein, 178 aa, Homo sapiens
  misc_feature: Heat shock protein cognate 71 kDa  Variant 16
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTA

SEQ ID NO: 84 - protein, 137 aa, Homo sapiens
  misc_feature: Heat shock protein cognate 71 kDa Variant 17
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGK

SEQ ID NO: 85 - protein, 1861 aa, Homo sapiens
  misc_feature: Ankyrin-3 Variant 2
MASSASSSPAGTEDSAPAQGGFGSDYSRSSRKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 86 - protein, 1868 aa, Homo sapiens
  misc_feature: Ankyrin-3 Variant 3
MSEEPKEKNAKPAHRKRKGKKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGNRCTWYKIPKVQEFTVKSEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 87 - protein, 1001 aa, Homo sapiens
  misc_feature: Ankyrin-3 Variant 4
MALPQSEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 88 - protein, 1643 aa, Homo sapiens
  misc_feature: Ankyrin-3 Variant 5
  misc_feature (1)..(1): Xaa can be any naturally occurring amino acid
XFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMKTVERSTGATRSLPTTYSYKPFFSTRPYQSWTTAPITVPGPAKSGFTSLSSSSSNTPSASPLKSIWSVSTPSPIKSTLGASTTSSVKSISDVASPIRSFRTMSSPIKTVVSQSPYNIQVSSGTLARAPAVTEATPLKGLASNSTFSSRTSPVTTAGSLLERSSITMTPPASPKSNINMYSSSLPFKSIITSAAPLISSPLKSVVSPVKSAVDVISSAKITMASSLSSPVKQMPGHAEVALVNGSISPLKYPSSSTLINGCKATATLQEKISSATNSVSSVVSAATDTVEKVFSTTTAMPFSPLRSYVSAAPSAFQSLRTPSASALYTSLGSSISATTSSVTSSIITVPVYSVVNVLPEPALKKLPDSNSFTKSAAALLSPIKTLTTETHPQPHFSRTSSPVKSSLFLAPSALKLSTPSSLSSSQEILKDVAEMKEDLMRMTAILQTDVPEEKPFQPELPKEGRIDDEEPFKIVEKVKEDLVKVSEILKKDVCVDNKGSPKSPKSDKGHSPEDDWIEFSSEEIREARQQAAASQSPSLPERVQVKAKAASEKDYNLTKVIDYLTNDIGSSSLTNLKYKFEDAKKDGEERQKRVLKPAIALQEHKLKMPPASMRTSTSEKELCKMADSFFGTDTILESPDDFSQHDQDKSPLSDSGFETRSEKTPSAPQSAESTGPKPLFHEVPIPPVITETRTEVVHVIRSYDPSAGDVPQTQPEEPVSPKPSPTFMELEPKPTTSSIKEKVKAFQMKASSEEDDHNRVLSKGMRVKEETHITTTTRMVYHSPPGGEGASERIEETMSVHDIMKAFQSGRDPSKELAGLFEHKSAVSPDVHKSAAETSAQHAEKDNQMKPKLERIIEVHIEKGPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 89 - protein, 973 aa, Homo sapiens
  misc_feature: Ankyrin-3 Variant 6
  misc_feature (1)..(1): Xaa can be any naturally occurring amino acid
XPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKETESDQDDEIEKTDRRQSFASLALRPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSEYPQYLGNLAGSPKDVKPAEPRKLGVSSEQQEKGKSGPDEEMMEEKLKSLFEDIQLEEGVESEEMTEEKVQAILKRVQQAELEMSSITGWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKDLKDSESDSSSEEERRVTTRVIRRRLIIKGEEAKNIPGESVTEEQFTDEEGNLITRKITRKVLRRIVIPQERKRDDVQGEGFKVKTKKEIRHVEKKSHS

SEQ ID NO: 90 - protein, 459 aa, Homo sapiens
  misc_feature: Ankyrin-3 Variant 7
PKTTKGLPQTAVCNLNITLPAHKKETESDQDDEIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 91 - protein, 96 aa, Homo sapiens
  misc_feature: Ankyrin-3 Variant 8
  misc_feature (1)..(1): Xaa can be any naturally occurring amino acid
XLARELNFSVDEINQIRVENPNSLISQSFMLLKKWVTRDGKNATTDALTSVLTKINRIDIVTLLEGPIFDYGNISGTRSFADENNVFHDPVDGNRI

SEQ ID NO: 92 - protein, 322 aa, Homo sapiens
  misc_feature: Ankyrin-3 Variant 9
  misc_feature (1)..(1): Xaa can be any naturally occurring amino acid
XGPDEDKPPSKSSSSEKTPDKTDQKSGAQFFTLEGRHPDRSVFPDTYFSYKVDEEFATPFKTVATKGLDFDPWSNNRGDDEVFDSKSREDETKPFGLAVEDRSPATTPDTTPARTPTDESTPTSEPNPFPFHEGKMFEMTRSGAIDMSKRDFVEERLQFFQIGPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGWQNETSSGNLESCAQARRVTGGLLDRLDDSPDQCRDSITSYL

SEQ ID NO: 93 - protein, 273 aa, Homo sapiens
MAVEEGESFPEQSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTR

SEQ ID NO: 94 - protein, 273 aa, Homo sapiens; identical to SEQ ID NO: 93
  misc_feature: Ankyrin-3 Variant 11

SEQ ID NO: 95 - protein, 241 aa, Homo sapiens
  misc_feature: Ankyrin-3 Variant 12
  misc_feature (1)..(1): Xaa can be any naturally occurring amino acid
XTVATKGLDFDPWSNNRGDDEVFDSKSREDETKPFGLAVEDRSPATTPDTTPARTPTDESTPTSEPNPFPFHEGKMFEMTRSGAIDMSKRDFVEERLQFFQIGPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTP

SEQ ID NO: 96 - protein, 178 aa, Homo sapiens
  misc_feature: Ankyrin-3 Variant 13
  misc_feature (1)..(1): Xaa can be any naturally occurring amino acid
XWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKGEGFKVKTKKEIRHVEKKSHS

SEQ ID NO: 97 - protein, 86 aa, Homo sapiens
  misc_feature: Ankyrin-3 Variant 14
MNVPETMNEVLDMSDDEGNRCTWYKIPKVQEFTVKSEDAMTGDTDKYLGPQDLKELGDDSLPAEGYMGFSLGARSARYFVVAVFHS

SEQ ID NO: 98 - protein, 195 aa, Homo sapiens
  misc_feature: Ankyrin-3 Variant 15
MTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSM

SEQ ID NO: 99 - protein, 166 aa, Homo sapiens
  misc_feature: Ankyrin-3 Variant 15
SPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKVKSPGAAPTRMTACCYKQGEGFKVKTKKEIRHVEKKSHS

SEQ ID NO: 100 - protein, 217 aa, Homo sapiens
  misc_feature: Ankyrin-3 Variant 17
  misc_feature (1)..(1): Xaa can be any naturally occurring amino acid
XLARELNFSVDEINQIRVENPNSLISQSFMLLKKWVTRDGKNATTDALTSVLTKINRIDIVTLLEGPIFDYGNISGTRSFADENNVFHDPVDVSPNVLSSIGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLES

SEQ ID NO: 101 - protein, 201 aa, Homo sapiens
  misc_feature: Ankyrin-3 Variant 18
  misc_feature (1)..(1): Xaa can be any naturally occurring amino acid
XEDAMTGDTDKYLGPQDLKELGDDSLPAEGYMGFSLGARSASPKISLRSFSSDRSYTLNRSSYARDSMMIEELLVPSKEQHLTFTREFDSDSLRHYSWAADTLDNVNLVSSPIHSGYSSPLPQYDSRFLVSFMVDARGGSMRGSRHHGMRIIIPPRKCTAPTRITCRLVKRHKLANPPPMVEGEGLASRLVEMGPAGAQFL

SEQ ID NO: 102 - protein, 196 aa, Homo sapiens
  misc_feature: Ankyrin-3 Variant 19
  misc_feature (1)..(1): Xaa can be any naturally occurring amino acid
XSSPIHSGFLVSFMVDARGGSMRGSRHHGMRIIIPPRKCTAPTRITCRLVKRHKLANPPPMVEGEGLASRLVEMGPAGAQFLGKLHLPTNPPPVNEGESLVSRILQLGPQGTKFIGPVIVEIPHFGSMRGKERELIVLRSENGETWKEHQFDSKNEDLTELLNGMDEELDSPEELGKKRICRIITKDFPQYFAVVS

SEQ ID NO: 103 - protein, 72 aa, Homo sapiens
  misc_feature: Ankyrin-3 Variant 20
MTGDTDKYLGPQDLKELGDDSLPAEGYMGFSLGARSASLRSFSSDRSYTLNRSSYARDSMMIEELLVPSKEQ

SEQ ID NO: 104 - protein, 187 aa, Homo sapiens
  misc_feature: Ankyrin-3 Variant 21
  misc_feature (1)..(1): Xaa can be any naturally occurring amino acid
XIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDDGPPVVTAEDASLEDSKLEDSVPLTEMPEAVDVDESQLENVC

SEQ ID NO: 105 - protein, 175 aa, Homo sapiens
  misc_feature: Ankyrin-3ariant 22
  misc_feature (1)..(1): Xaa can be any naturally occurring amino acid
XSPLAAYQKSLEETSKLIIEETKPCVPVSMKKMSRTSPADGKPRLSLHEEEGSSGSEQKVKSPGAAPTRMTACCYKDLKDSESDSSSEEERRVTTRVIRRRLIIKGEEAKNIPGESVTEEQFTDEEGNLITRKITRKVLRRIVIPQERKRDDVQGEGFKVKTKKEIRHVEKKSHS

SEQ ID NO: 106 - protein, 159 aa, Homo sapiens
  misc_feature: Ankyrin-3 Variant 23
MTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPP

SEQ ID NO: 107 - protein, 63 aa, Homo sapiens
  misc_feature: Ankyrin-3 Variant 24
MTGDTDKYLGPQDLKELGDDSLPAEGYMGFSLGARSASHAASTVAKELTDKTGRTNLSHIFQN

SEQ ID NO: 108 - protein, 1738 aa, Homo sapiens
  misc_feature: Rho GTPase-activating protein 32 Variant 2
MKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLERKRPQNKMKKSPVGSWRSFFNLGKSSSVSKRKLQRNESEPSEMKAMALKGGRAEGTLRSAKSEESLTSLHAVDGDSKLFRPRRPRSSSDALSASFNGEMLGNRCNSYDNLPHDNESEEEGGLLHIPALMSPHSAEDVDLSPPDIGVASLDFDPMSFQCSPPKAESECLESGASFLDSPGYSKDKPSANKKDAETGSSQCQTPGSTASSEPVSPLQEKLSPFFTLDLSPTEDKSSKPSSFTEKVVYAFSPKIGRKLSKSPSMSISEPISVTLPPRVSEVIGTVSNTTAQNASSSTWDKCVEERDATNRSPTQIVKMKTNETVAQEAYESEVQPLDQVAAEEVELPGKEDQSVSSSQSKAVASGQTQTGAVTHDPPQDSVPVSSVSLIPPPPPPKNVARMLALALAESAQQASTQSLKRPGTSQAGYTNYGDIAVATTEDNLSSSYSAVALDKAYFQTDRPAEQFHLQNNAPGNCDHPLPETTATGDPTHSNTTESGEQHHQVDLTGNQPHQAYLSGDPEKARITSVPLDSEKSDDHVSFPEDQSGKNSMPTVSFLDQDQSPPRFYSGDQPPSYLGASVDKLHHPLEFADKSPTPPNLPSDKIYPPSGSPEENTSTATMTYMTTTPATAQMSTKEASWDVAEQPTTADFAAATLQRTHRTNRPLPPPPSQRSAEQPPVVGQVQAATNIGLNNSHKVQGVVPVPERPPEPRAMDDPASAFISDSGAAAAQCPMATAVQPGLPEKVRDGARVPLLHLRAESVPAHPCGFPAPLPPTRMMESKMIAAIHSSSADATSSSNYHSFVTASSTSVDDALPLPLPVPQPKHASQKTVYSSFARPDVTTEPFGPDNCLHFNMTPNCQYRPQSVPPHHNKLEQHQVYGARSEPPASMGLRYNTYVAPGRNASGHHSKPCSRVEYVSSLSSSVRNTCYPEDIPPYPTIRRVQSLHAPPSSMIRSVPISRTEVPPDDEPAYCPRPLYQYKPYQSSQARSDYHVTQLQPYFENGRVHYRYSPYSSSSSSYYSPDGALCDVDAYGTVQLRPLHRLPNRDFAFYNPRLQGKSLYSYAGLAPRPRANVTGYFSPNDHNVVSMPPAADVKHTYTSWDLEDMEKYRMQSIRRESRARQKVKGPVMSQYDNMTPAVQDDLGGIYVIHLRSKSDPGKTGLLSVAEGKESRHAAKAISPEGEDRFYRRHPEAEMDRAHHHGGHGSTQPEKPSLPQKQSSLRSRKLPDMGCSLPEHRAHQEASHRQFCESKNGPPYPQGAGQLDYGSKGIPDTSEPVSYHNSGVKYAASGQESLRLNHKEVRLSKEMERPWVRQPSAPEKHSRDCYKEEEHLTQSIVPPPKPERSHSLKLHHTQNVERDPSVLYQYQPHGKRQSSVTVVSQYDNLEDYHSLPQHQRGVFGGGGMGTYVPPGFPHPQSRTYATALGQGAFLPAELSLQHPETQIHAE

SEQ ID NO: 109 - protein, 1738 aa, Homo sapiens; identical to SEQ ID NO: 108
  misc_feature: Rho GTPase-activating protein 32 Variant 3

SEQ ID NO: 110 - protein, 946 aa, Homo sapiens
  misc_feature: Rho GTPase-activating protein 32 Variant 4
MARGADVPEIPGDLTLKTCGSTASMKVKHVKKLPFTKGHFPKMAECAHFHYENVEFGSIQLSLSEEQNEVMKNGCESKELVYLVQIACQGKSWIVKRSYEDFRVLDKHLHLCIYDRRFSQLSELPRSDTLKDSPESVTQMLMAYLSRLSAIAGNKINCGPALTWMEIDNKGNHLLVHEESSINTPAVGAAHVIKRYTARAPDELTLEVGDIVSVIDMPPKVLSTWWRGKHGFQVGLFPGHCVELINQKVPQSVTNSVPKPVSKKHGKLITFLRTFMKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLERKRPQNKMKKSPVGSWRSFFNLGKSSSVSKRKLQRNESEPSEMKAMALKGGRAEGTLRSAKSEESLTSLHAVDGDSKLFRPRRPRSSSDALSASFNGEMLGNRCNSYDNLPHDNESEEEGGLLHIPALMSPHSAEDVDLSPPDIGVASLDFDPMSFQCSPPKAESECLESGASFLDSPGYSKDKPSANKKDAETGSSQCQTPGSTASSEPVSPLQEKLSPFFTLDLSPTEDKSSKPSSFTEKVVYAFSPKIGRKLSKSPSMSISEPISVTLPPRVSEVIGTVSNTTAQNASSSTWDKCVEERDATNRSPTQIVKMKTNETVAQEAYESEVQPLDQVAAEEVELPGKEDQSVSSSQSKAVASGQTQTGTVCFPPFFL

SEQ ID NO: 111 - protein, 178 aa, Homo sapiens
  misc_feature: Rho GTPase-activating protein 32 Variant 5
MKSSVHSEEDDFVPELHRNVHPRERPDWEETLSAMARGADVPEIPGDLTLKTCGSTASMKVKHVKKSTTPGLMGCDNIHRLPFTKGHFPKMAECAHFHYENVEFGSIQLSLSEEQNEVMKNGCESKELVYLVQIACQGKSWIVKRSYEDFRVLDKHLHLCIYDRRFSQLSELPRSDTL

SEQ ID NO: 112 - protein, 410 aa, Homo sapiens
  misc_feature: Cytoskeletal Keratin 78 type II Variant 2
MEGHEASPAQVGQGDRGKVRFLEQQNKVLETKWHLLQQQGLSGSQQGLEPVFEACLDQLRKQLEQLQGERGALDAELKACRDQEEEYKSKYEEEAHRRATLENDFVVLKKDVDGVFLSKMELEGKLEALREYLYFLKHLNEEELGQLQTQASDTSVVLSMDNNRYLDFSSIITEVRARYEEIARSSKAEAEALYQTKYQELQVSAQLHGDRMQETKVQISQLHQEIQRLQSQTENLKKQNASLQAAITDAEQRGELALKDAQAKVDELEAALRMAKQNLARLLCEYQELTSTKLSLDVEIATYRRLLEGEECRMSGECTSQVTISSVGGSAVMSGGVGGGLGSTCGLGSGKGSPGSCCTSIVTGGSNIILGSGKDPVLDSCSVSGSSAGSSCHTILKKTVESSLKTSITY

SEQ ID NO: 113 - protein, 41 aa, Homo sapiens
  misc_feature: Cytoskeletal Keratin 78 type II Variant 3
  misc_feature (1)..(1): Xaa can be any naturally occurring amino acid
XDVEIATYRRLLEGEECSLGGRQRCHVWRSWWRLGEHLWTR

SEQ ID NO: 114 - protein, 2971 aa, Homo sapiens
  misc_feature: Collagen type VI, alpha 3 Variant 2
MRKHRHLPLVAVFCLFLSGFPTTHAQQQQAAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 115 - protein, 2971 aa, Homo sapiens; identical to SEQ ID NO: 114
  misc_feature: Collagen type VI, alpha 3 Variant 3

SEQ ID NO: 116 - protein, 2570 aa, Homo sapiens
  misc_feature: Collagen type VI, alpha 3 Variant 4
MRKHRHLPLVAVFCLFLSGFPTTHAQQQQAVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 117 - protein, 1237 aa, Homo sapiens
  misc_feature: Collagen type VI, alpha 3 Variant 5
MRKHRHLPLVAVFCLFLSGFPTTHAQQQQAAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPGEMGASEVLLGAFSI

SEQ ID NO: 118 - protein, 1036 aa, Homo sapiens
  misc_feature: Collagen type VI, alpha 3 Variant 6
MRKHRHLPLVAVFCLFLSGFPTTHAQQQQAVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPGEMGASEVLLGAFSI

SEQ ID NO: 119 - protein, 2569 aa, Homo sapiens
  misc_feature: Collagen type VI, alpha 3 Variant 7
MRKHRHLPLVAVFCLFLSGFPTTHAQQQQAVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPFHGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 120 - protein, 708 aa, Homo sapiens
  misc_feature: Collagen type VI, alpha 3 Variant 8
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEESKRDILFLFDGSANLVGQFPVVRDFLYKIIDELNVKPEGTRIAVAQYSDDVKVESRFDEHQSKPEILNLVKRMKI

SEQ ID NO: 121 - protein, 173 aa, Homo sapiens
  misc_feature: Collagen type VI, alpha 3 Variant 9
PIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQEYGLNENW

SEQ ID NO: 122 - protein, 203 aa, Homo sapiens
  misc_feature: Proteasome subunit beta type-5 Variant 2
MALASVLERPLPVNQRGFFGLGGRADLLDLGPGSLSDGLSLAAPGWGVPEEPGIEMLHGTTTLAFKFRHGVIVAADSRATAGAYIASQTVKKVIEINPYLLGTMAGGAADCSFWERLLARQCRIYELRNKERISVAAASKLLANMVYQYKGMGLSMGTMICGWDKRGPVSEVLCLKPKSFGMYLFCGCAERIGNMARPLLRGQ

SEQ ID NO: 123 - protein, 160 aa, Homo sapiens
  misc_feature: Proteasome subunit beta type-5 Variant 3
MAGGAADCSFWERLLARQCRIYELRNKERISVAAASKLLANMVYQYKGMGLSMGTMICGWDKRGPGLYYVDSEGNRISGATFSVGSGSVYAYGVMDRGYSYDLEVEQAYDLARRAIYQATYRDAYSGGAVNLYHVREDGWIRVSSDNVADLHEKYSGSTP

SEQ ID NO: 124 - protein, 84 aa, Homo sapiens
  misc_feature: Proteasome subunit beta type-5 Variant 4
MALASVLERPLPVNQRGFFGLGGRADLLDLGPGSLSDGLSLAAPGWGVPEEPGIEMLHGTTTLAFKASTTWTVKGTGFQGPPSL

SEQ ID NO: 125 - protein, 118 aa, Homo sapiens
  misc_feature: Proteasome subunit beta type-5 Variant 5
  misc_feature (1)..(1): Xaa can be any naturally occurring amino acid
XGIEMLHGTTTLAFKFRHGVIVAADSRATAGAYIASQTVKKVIEINPYLLGTMAGGAADCSFWERLLARQCRIYELRNKERISVAAASKLLANMVYQYKGMGLSMGTMICGWDKRGPG

SEQ ID NO: 126 - protein, 341 aa, Homo sapiens
  misc_feature: Heterogeneous nuclear ribonucleoproteins A2/B1 Variant 2
MEREKEQFRKLFIGGLSFETTEESLRNYYEQWGKLTDCVVMRDPASKRSRGFGFVTFSSMAEVDAAMAARPHSIDGRVVEPKRAVAREESGKPGAHVTVKKLFVGGIKEDTEEHHLRDYFEEYGKIDTIEIITDRQSGKKRGFGFVTFDDHDPVDKIVLQKYHTINGHNAEVRKALSRQEMQEVQSSRSGRGGNFGFGDSRGGGGNFGPGPGSNFRGGSDGYGSGRGFGDGYNGYGGGPGGGNFGGSPGYGGGRGGYGGGGPGYGNQGGGYGGGYDNYGGGNYGSGNYNDFGNYNQQPSNYGPMKSGNFGGSRNMGGPYGGGNYGPGGSGGSGGYGGRSRY

SEQ ID NO: 127 - protein, 341 aa, Homo sapiens; identical to SEQ ID NO: 126
  misc_feature: Heterogeneous nuclear ribonucleoproteins A2/B1 Variant 3

SEQ ID NO: 128 - protein, 261 aa, Homo sapiens
  misc_feature: Heterogeneous nuclear ribonucleoproteins A2/B1 Variant 4
MEKTLETVPLERKKREKEQFRKLFIGGLSFETTEESLRNYYEQWGKLTDCVVMRDPASKRSRGFGFVTFSSMAEVDAAMAARPHSIDGRVVEPKRAVAREESGKPGAHVTVKKLFVGGIKEDTEEHHLRDYFEEYGKIDTIEIITDRQSGKKRGFGFVTFDDHDPVDKIVLQKYHTINGHNAEVRKALSRQEMQEDLEVAILEVAPVMEEEEEDMVVEDLDMATRVGATEVVMTTMEEEIMEVEITMILEIITSNLLTTVQ

SEQ ID NO: 129 - protein, 434 aa, Homo sapiens; identical to SEQ ID NO: 18
  misc_feature: Beta enolaseVariant 2

SEQ ID NO: 130 - protein, 434 aa, Homo sapiens; identical to SEQ ID NO: 18
  misc_feature: Beta enolase Variant 3

SEQ ID NO: 131 - protein, 391 aa, Homo sapiens
  misc_feature: Beta enolase Variant 3
MAMQKIFAREILDSRGNPTVEVDLHTAKGRFRAAVPSGASTGIYEALELRDGDKGRYLGKAKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGELYKSFIKNYPVVSIEDPFDQDDWATWTSFLSGVNIQIVGDDLTVTNPKRIAQAVEKKACNCLLLKVNQIGSVTESIQACKLAQSNGWGVMVSHRSGETEDTFIADLVVGLCTGQIKTGAPCRSERLAKYNQLMRIEEALGDKAIFAGRKFRNPKAK

SEQ ID NO: 132 - protein, 212 aa, Homo sapiens
  misc_feature: Beta enolase Variant 5
MAMQKIFAREILDSRGNPTVEVDLHTAKGRFRAAVPSGASTGIYEALELRDGDKGRYLGKGVLKAVENINNTLGPALLQKKLSVVDQEKVDKFMIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGG

SEQ ID NO: 133 - protein, 196 aa, Homo sapiens
  misc_feature: Beta enolase Variant 6
MAMQKIFAREILDSRGNPTVEVDLHTAKGRFRAAVPSGASTGIYEALELRDGDKGRYLGKGVLKAVENINNTLGPALLQKKLSVVDQEKVDKFMIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVI

SEQ ID NO: 134 - protein, 148 aa, Homo sapiens
  misc_feature: Beta enolase Variant 7
MAMQKIFAREILDSRGNPTVEVDLHTAKGRFRAAVPSGASTGIYEALELRDGDKGRYLGKGVLKAVENINNTLGPALLQKKLSVVDQEKVDKFMIELDGTENKSKFGANAILGVSLAVCKAGAAEKGVPLYRHIADLAGNPDLILPVP

SEQ ID NO: 135 - protein, 148 aa, Homo sapiens; identical to SEQ ID NO: 134
  misc_feature: Beta enolase Variant 8

SEQ ID NO: 136 - protein, 154 aa, Homo sapiens
  misc_feature: Beta enolase Variant 9
MAMQKIFAREILDSRGNPTVEVDLHTAKGRFRAAVPSGASTGIYEALELRDGDKGRYLGKGVLKAVENINNTLGPALLQKKLSVVDQEKVDKFMIELDGTENKSKFGANAILGVSLAVCKAGAAEKGVPLYRHIADLAGNPDLILPVPAFNVIN

SEQ ID NO: 137 - protein, 28 aa, Homo sapiens
  misc_feature: Beta enolase Variant 10
MAMQKIFAREILDSRGNPTVEVDLHTAK

SEQ ID NO: 138 - protein, 174 aa, Homo sapiens
  misc_feature: Glutathione S-transferase P Variant 2
MPPYTVVYFPVRGRCAALRMLLADQGQSWKEEVVTVETWQEGSLKASCLYGQLPKFQDGDLTLYQSNTILRHLGRTLGLYGKDQQEAALVDMVNDGVEDLRCKYISLIYTNYISFADYNLLDLLLIHEVLAPGCLDAFPLLSAYVGRLSARPKLKAFLASPEYVNLPINGNGKQ

SEQ ID NO: 139 - protein, 69 aa, Homo sapiens
  misc_feature: Glutathione S-transferase P Variant 3
EAGKDDYVKALPGQLKPFETLLSQNQGGKTFIVGDQVSIWPHAVPSSPPSASRWTQVSPSLTTTCWTCC

SEQ ID NO: 140 - protein, 166 aa, Homo sapiens
  misc_feature: Glutathione S-transferase Mu 3 Variant 2
MSCESSMVLGYWDIRGLAHAIRLLLEFTDTSYEEKRYTCGEAPDYDRSQWLDVKFKLDLDFPNLPYLLDGKNKITQSNAILRYIARKHNMCGETEEEKIRVDIIENQVMDFRTQLIRLCYSSDHEKLKPQYLEELPGQLKQFSMFLGKFSWFAGEKLTFVDFLTYD

SEQ ID NO: 141 - protein, 212 aa, Homo sapiens [sequence omitted]

SEQ ID NO: 142 - protein, 1144 aa, Homo sapiens
  misc_feature: ARHGAP23 Variant 2
MNGVAFCLVGIPPRPEPRPPQLPLGPRDGCSPRRPFPWQGPRTLLLYKSPQDGFGFTLRHFIVYPPESAVHCSLKEEENGGRGGGPSPRYRLEPMDTIFVKNVKEDGPAHRAGLRTGDRLVKVNGESVIGKTYSQVIALIQNSDDTLELSIMPKDEDILQLAYSQDAYLKGNEPYSGEARSIPEPPPICYPRKTYAPPARASTRATMVPEPTSALPSDPRSPAAWSDPGLRVPPAARAHLDNSSLGMSQPRPSPGAFPHLSSEPRTPRAFPEPGSRVPPSRLECQQALSHWLSNQVPRRAGERRCPAMAPRARSASQDRLEEVAAPRPWPCSTSQDALSQLGQEGWHRARSDDYLSRATRSAEALGPGALVSPRFERCGWASQRSSARTPACPTRDLPGPQAPPPSGLQGLDDLGYIGYRSYSPSFQRRTGLLHALSFRDSPFGGLPTFNLAQSPASFPPEASEPPRVVRPEPSTRALEPPAEDRGDEVVLRQKPPTGRKVQLTPARQMNLGFGDESPEPEASGRGERLGRKVAPLATTEDSLASIPFIDEPTSPSIDLQAKHVPASAVVSSAMNSAPVLGTSPSSPTFTFTLGRHYSQDCSSIKAGRRSSYLLAITTERSKSCDDGLNTFRDEGRVLRRLPNRIPSLRMLRSFFTDGSLDSWGTSEDADAPSKRHSTSDLSDATFSDIRREGWLYYKQILTKKGKKAGSGLRQWKRVYAALRARSLSLSKERREPGPAAAGAAAAGAGEDEAAPVCIGSCLVDISYSETKRRHVFRLTTADFCEYLFQAEDRDDMLGWIRAIRENSRAEGEDPGCANQALISKKLNDYRKVSHSSGPKADSSPKGSRGLGGLKSEFLKQSAARGLRTQDLPAGSKDDSAAAPKTPWGINIIKKNKKAAPRAFGVRLEECQPATENQRVPLIVAACCRIVEARGLESTGIYRVPGNNAVVSSLQEQLNRGPGDINLQDERWQDLNVISSLLKSFFRKLPEPLFTDDKYNDFIEANRIEDARERMRTLRKLIRDLPGHYYETLKFLVGHLKTIADHSEKNKMEPRNLALVFGPTLVRTSEDNMTDMVTHMPDRYKIVETLIQHSDWFFSDEEDKGERTPVGDKEPQAVPNIEYLLPNIGRTVPPGDPGSADLLEI

SEQ ID NO: 143 - protein, 102 aa, Homo sapiens
  misc_feature: ARHGAP23 Variant 3
MDTIFVKNVKEDGPAHRAGLRTGDRLVKVNGESVIGKTYSQVIALIQNSDDTLELSIMPKDEDILQLAYSQDAYLKGNEPYSGEARSIPEPPPICYPRKTYA

SEQ ID NO: 144 - protein, 64 aa, Homo sapiens
  misc_feature: ARHGAP23 Variant 4
  misc_feature (1)..(1): Xaa can be any naturally occurring amino acid
XFFSDEEDKGERTPVGDKEPQAVPNIEYLLPNIGRTVPPGDPGSDSTTCSSAKSKVRMKAILKA

SEQ ID NO: 145 - protein, 163 aa, Homo sapiens
  misc_feature: ARHGAP23 Variant 5
  misc_feature (1)..(1): Xaa can be any naturally occurring amino acid
XTFSDIRREGWLYYKQILTKKGKAEDRDDMLGWIRAIRENSRAEGEDPGCANQALISKKLNDYRKVSHSSGPKADSSPKGSRGLGGLKSEFLKQSAARGLRTQDLPAGSKDDSAAAPKTPWGINIIKKNKKAAPRAFGVRLEECQPATENQRVPLIVAACCRI

SEQ ID NO: 146 - protein, 135 aa, Homo sapiens
  misc_feature: ARHGAP23 Variant 6
IRDLPGHYYETLKFLVGHLKTIADHSEKNKMEPRNLALVFGPTLVRTSEDNMTDMVTHMPDRYKIVETLIQHSDWFFSDEEDKGERILPPVVQPSPRVRGPPRRSRTPGRCWRSPSSRPSTASARSGGRRGGWAA

SEQ ID NO: 147 - protein, 2087 aa, Homo sapiens
  misc_feature: Rho 32
  misc_feature: or Rho GTPase-activating protein 32 (ARHGAP32)
METESESSTLGDDSVFWLESEVIIQVTDCEEEEREEKFRKMKSSVHSEEDDFVPELHRNVHPRERPDWEETLSAMARGADVPEIPGDLTLKTCGSTASMKVKHVKKLPFTKGHFPKMAECAHFHYENVEFGSIQLSLSEEQNEVMKNGCESKELVYLVQIACQGKSWIVKRSYEDFRVLDKHLHLCIYDRRFSQLSELPRSDTLKDSPESVTQMLMAYLSRLSAIAGNKINCGPALTWMEIDNKGNHLLVHEESSINTPAVGAAHVIKRYTARAPDELTLEVGDIVSVIDMPPKVLSTWWRGKHGFQVGLFPGHCVELINQKVPQSVTNSVPKPVSKKHGKLITFLRTFMKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLERKRPQNKMKKSPVGSWRSFFNLGKSSSVSKRKLQRNESEPSEMKAMALKGGRAEGTLRSAKSEESLTSLHAVDGDSKLFRPRRPRSSSDALSASFNGEMLGNRCNSYDNLPHDNESEEEGGLLHIPALMSPHSAEDVDLSPPDIGVASLDFDPMSFQCSPPKAESECLESGASFLDSPGYSKDKPSANKKDAETGSSQCQTPGSTASSEPVSPLQEKLSPFFTLDLSPTEDKSSKPSSFTEKVVYAFSPKIGRKLSKSPSMSISEPISVTLPPRVSEVIGTVSNTTAQNASSSTWDKCVEERDATNRSPTQIVKMKTNETVAQEAYESEVQPLDQVAAEEVELPGKEDQSVSSSQSKAVASGQTQTGAVTHDPPQDSVPVSSVSLIPPPPPPKNVARMLALALAESAQQASTQSLKRPGTSQAGYTNYGDIAVATTEDNLSSSYSAVALDKAYFQTDRPAEQFHLQNNAPGNCDHPLPETTATGDPTHSNTTESGEQHHQVDLTGNQPHQAYLSGDPEKARITSVPLDSEKSDDHVSFPEDQSGKNSMPTVSFLDQDQSPPRFYSGDQPPSYLGASVDKLHHPLEFADKSPTPPNLPSDKIYPPSGSPEENTSTATMTYMTTTPATAQMSTKEASWDVAEQPTTADFAAATLQRTHRTNRPLPPPPSQRSAEQPPVVGQVQAATNIGLNNSHKVQGVVPVPERPPEPRAMDDPASAFISDSGAAAAQCPMATAVQPGLPEKVRDGARVPLLHLRAESVPAHPCGFPAPLPPTRMMESKMIAAIHSSSADATSSSNYHSFVTASSTSVDDALPLPLPVPQPKHASQKTVYSSFARPDVTTEPFGPDNCLHFNMTPNCQYRPQSVPPHHNKLEQHQVYGARSEPPASMGLRYNTYVAPGRNASGHHSKPCSRVEYVSSLSSSVRNTCYPEDIPPYPTIRRVQSLHAPPSSMIRSVPISRTEVPPDDEPAYCPRPLYQYKPYQSSQARSDYHVTQLQPYFENGRVHYRYSPYSSSSSSYYSPDGALCDVDAYGTVQLRPLHRLPNRDFAFYNPRLQGKSLYSYAGLAPRPRANVTGYFSPNDHNVVSMPPAADVKHTYTSWDLEDMEKYRMQSIRRESRARQKVKGPVMSQYDNMTPAVQDDLGGIYVIHLRSKSDPGKTGLLSVAEGKESRHAAKAISPEGEDRFYRRHPEAEMDRAHHHGGHGSTQPEKPSLPQKQSSLRSRKLPDMGCSLPEHRAHQEASHRQFCESKNGPPYPQGAGQLDYGSKGIPDTSEPVSYHNSGVKYAASGQESLRLNHKEVRLSKEMERPWVRQPSAPEKHSRDCYKEEEHLTQSIVPPPKPERSHSLKLHHTQNVERDPSVLYQYQPHGKRQSSVTVVSQYDNLEDYHSLPQHQRGVFGGGGMGTYVPPGFPHPQSRTYATALGQGAFLPAELSLQHPETQIHAE

What is claimed is:

1. A method comprising:
   a) detecting increased expression farnesyl pyrophosphate synthase in a sample from a subject;
   b) performing a biopsy to diagnose cervical cancer or a cervical lesion; and
   c) administering a treatment to the subject, wherein the treatment is selected from the group consisting of cisplatin, carboplatin, paclitaxel, topotecan, docetaxel, ifosfamide, 5-fluorouracil, irinotecan, gemcitabine, mitomycin, bevacizumab and pembrolizumab.

2. The method of claim 1, wherein the sample is a blood sample.

3. The method of claim 1, wherein the subject is human.

4. The method of claim 1, further comprising detecting Ankyrin-3.

5. The method of claim 1, wherein the detecting is by protein microarray, fluorescence detection, flow cytometry, microfluidic device, lateral flow assay, vertical flow assay or immunoassay.

6. The method of claim 5, wherein the detecting is by lateral flow.

7. The method of claim 1, further comprising performing a Pap smear.

* * * * *